US012503710B2

(12) United States Patent
Thomas et al.

(10) Patent No.: US 12,503,710 B2
(45) Date of Patent: Dec. 23, 2025

(54) BASE EDITING ENZYMES

(71) Applicant: Metagenomi, Inc., Emeryville, CA (US)

(72) Inventors: Brian C. Thomas, Berkeley, CA (US); Jyun-Liang Lin, Emeryville, CA (US); Alan Brooks, Clayton, CA (US); Cristina Butterfield, Oakland, CA (US); Christopher Brown, Albany, CA (US); Cindy Castelle, San Francisco, CA (US); Morayma Temoche-Diaz, Oakland, CA (US); Benjamin Freeman, Emeryville, CA (US); Christine Romano, Emeryville, CA (US); Rebecca Lamothe, Albany, CA (US)

(73) Assignee: Metagenomi, Inc., Emeryville, CA (US)

( * ) Notice: Subject to any disclaimer, the term of this patent is extended or adjusted under 35 U.S.C. 154(b) by 0 days.

(21) Appl. No.: 18/653,454

(22) Filed: May 2, 2024

(65) Prior Publication Data

US 2024/0309404 A1 Sep. 19, 2024

Related U.S. Application Data

(63) Continuation of application No. PCT/US2022/079345, filed on Nov. 4, 2022.

(60) Provisional application No. 63/378,171, filed on Oct. 3, 2022, provisional application No. 63/356,888, filed on Jun. 29, 2022, provisional application No. 63/342,824, filed on May 17, 2022, provisional application No. 63/289,998, filed on Dec. 15, 2021, provisional application No. 63/276,461, filed on Nov. 5, 2021.

(51) Int. Cl.

| | |
|---|---|
| *C12N 15/90* | (2006.01) |
| *C12N 9/22* | (2006.01) |
| *C12N 9/78* | (2006.01) |
| *C12N 15/11* | (2006.01) |

(52) U.S. Cl.

CPC ............... *C12N 15/90* (2013.01); *C12N 9/22* (2013.01); *C12N 9/78* (2013.01); *C12N 15/11* (2013.01); *C12Y 305/04* (2013.01); *C12Y 305/04002* (2013.01); *C12Y 305/04004* (2013.01); *C12Y 305/04005* (2013.01); *C12N 2310/20* (2017.05)

(58) Field of Classification Search

None

See application file for complete search history.

(56) References Cited

U.S. PATENT DOCUMENTS

| | | | |
|---|---|---|---|
| 12,286,654 | B2 | 4/2025 | Lin et al. |
| 2018/0170984 | A1 | 6/2018 | Harris et al. |
| 2018/0258418 | A1 | 9/2018 | Kim |
| 2018/0371498 | A1 | 12/2018 | Gill et al. |
| 2022/0364067 | A1 | 11/2022 | Lin et al. |
| 2023/0348876 | A1 | 11/2023 | Lin et al. |
| 2023/0348877 | A1 | 11/2023 | Lin et al. |
| 2023/0374482 | A1 | 11/2023 | Thomas et al. |

FOREIGN PATENT DOCUMENTS

| | | | |
|---|---|---|---|
| EP | 3617311 | A1 | 3/2020 |
| WO | WO-2018176009 | A1 | 9/2018 |
| WO | WO-2019005884 | A1 | 1/2019 |
| WO | WO-2019118935 | A1 | 6/2019 |
| WO | WO-2020163396 | A1 | 8/2020 |
| WO | WO-2020168234 | A1 | 8/2020 |
| WO | WO-2020168291 | A1 | 8/2020 |
| WO | WO-2021097118 | A1 | 5/2021 |
| WO | WO-2021202568 | A1 | 10/2021 |
| WO | WO-2022056301 | A1 | 3/2022 |
| WO | WO-2022056324 | A1 | 3/2022 |
| WO | WO-2023081855 | A1 | 5/2023 |

OTHER PUBLICATIONS

Zhao, Y., Tian, J., Zheng, G., Chen, J., Sun, C., Yang, Z., . . . & Lu, Y. (2020). Multiplex genome editing using a dCas9-cytidine deaminase fusion in *Streptomyces*. Science China Life Sciences, 63, 1053-1062. (Year: 2020).*

Conticello, S.G., 2008. The AID/APOBEC family of nucleic acid mutators. Genome biology, 9, pp. 1-10. (Year: 2008).*

Kim, D., Luk, K., Wolfe, S. A., & Kim, J. S. (2019). Evaluating and enhancing target specificity of gene-editing nucleases and deaminases. Annual review of biochemistry, 88(1), 191-220. (Year: 2019).*

Baker et al. Did Dendritic Cell Activation, Induced by Adenovirus-Antibody Complexes, Play a Role in the Death of Jesse Gelsinger? Molecular therapy. vol. 28,3: pp. 704-706 (2020).

Brinkman et al. Easy Quantitative Assessment of Genome Editing by Sequence Trace Decomposition. Nucleic Acids Research vol. 42,22: e168, pp. 1-8 (2014).

Carreras, Alba et al. In Vivo Genome and Base Editing of a Human PCSK9 Knock-in Hypercholesterolemic Mouse Model. BMC Biology vol. 17,1: pp. 1-14 (2019).

Deyle, David R et al. Adeno-Associated Virus Vector Integration. Current Opinion in Molecular Therapeutics. vol. 11,4: pp. 442-447 (2009).

Feng, Y. et al., FAM72A antagonizes UNG2 to promote mutagenic repair during antibody maturation, Nature, Dec. 2021, vol. 600, No. 7888, pp. 324-328.

Finn, Jonathan D et al. A Single Administration of CRISPR/Cas9 Lipid Nanoparticles Achieves Robust and Persistent In Vivo Genome Editing. Cell Reports vol. 22,9: pp. 2227-2235 (2018).

(Continued)

*Primary Examiner* — Brian Whiteman
*Assistant Examiner* — Khaleda B Hasan
(74) *Attorney, Agent, or Firm* — Wilson Sonsini Goodrich & Rosati

(57) ABSTRACT

The present disclosure provides for endonuclease enzymes having distinguishing domain features, as well as methods of using such enzymes or variants thereof.

30 Claims, 49 Drawing Sheets

Specification includes a Sequence Listing.

(56) References Cited

OTHER PUBLICATIONS

Gaudelli, Nicole M. et al. Directed Evolution of Adenine Base Editors with Increased Activity and Therapeutic Application. Nature Biotechnology 38(7):892-900 (2020).
Gaudelli, Nicole M. et al. Programmable Base Editing of A•T to G•C In Genomic DNA Without DNA Cleavage. Nature 551(7681):464-471 (2017).
Herbert et al.: Increased secretion of lipoproteins in transgenic mice expressing human D374Y PCSK9 under physiological genetic control. Arterioscler Thromb Vasc Biol. 30(7):1333-1339 doi:10.1161/ATVBAHA.110.204040 (2010).
Humphrey W et al. VMD: Visual Molecular Dynamics. Journal of Molecular Graphics vol. 14,1: pp. 33-38 (1996).
Jeong, You Kyeong et al. Adenine Base Editor Engineering Reduces Editing of Bystander Cytosines. Nature Biotechnology vol. 39,11: pp. 1426-1433 (2021).
Jinek, Martin et al. A Programmable Dual-RNA-guided DNA Endonuclease in Adaptive Bacterial Immunity. Science 337(6096):816-821 (2012).
Kim, Daesik et al. Genome-Wide Target Specificities of CRISPR RNA-guided Programmable Deaminases. Nature Biotechnology vol. 35,5: pp. 475-480 (2017).
Kim, Kyoungmi et al. Highly Efficient RNA-Guided Bases Editing in Mouse Embryos. Nature biotechnology vol. 35,5: pp. 435-437 (2017).
Kohli et al.: A portable hot spot recognition loop transfers sequence preferences from APOBEC family members to activation-induced cytidine deaminase. J Biol Chem. 284(34):22898-22904 doi:10.1074/jbc.M109.025536 (2009).
Levy, Jonathan M. et al. Cytosine and Adenine Base Editing of the Brain, Liver, Retina, Heart and Skeletal Muscle of Mice via Adeno-associated Viruses. Nature Biomedical Engineering 4(1):97-110 (2020).
Liu et al.: Application of different types of CRISPR/Cas-based systems in bacteria. Microb Cell Fact. 19(1):172:1-14 doi:10.1186/s12934-020-01431-z (2020).
Mali, Prashant et al. RNA-Guided Human Genome Engineering via Cas9. Science 339(6121):823-826 (2013).
Mishra et al.: Base editing in crops: current advances, limitations and future implications. Plant Biotechnol J. 18(1):20-31 doi:10.1111/pbi.13225 (2020).
Mok, Beverly Y et al. A Bacterial Cytidine Deaminase Toxin Enables CRISPR-free Mitochondrial Base Editing. Nature vol. 583,7817: pp. 631-637 (2020).
Moon et al.: Recent advances in the CRISPR genome editing tool set. Exp Mol Med. 51(130):1-11 (2019).
NCBI GenBank Accession No. EDV12729.1: tRNA-specific adenosine deaminase 2 [*Saccharomyces cerevisiae* RM11-1a], Published Jul. 26, 2016.
NCBI GenBank Accession No. WP_094758060.1: Hnh endonuclease [*Rothia* sp. Olga], Published Jul. 27, 2021.
PCT/US2021/049931 International Search Report and Written Opinion dated Jan. 12, 2022.
PCT/US2021/049962 International Search Report and Written Opinion dated Feb. 25, 2022.
PCT/US2022/079345 International Search Report and Written Opinion dated Mar. 2, 2023.
Rathore, A.. et al., "The Local Dinucleotide Preference of APOBEC3G Can Be Altered from 5'-CC to 5'-TC by a Single Amino Acid Substitution", J. Mol Biol., 2013, vol. 425, pp. 4442-4454.
Ribeiro, et al. Protein Engineering Strategies to Expand CRISPR-Cas9 Applications. International Journal of Genomics, vol. 2018, Aug. 2, 2018, pp. 1-12.
Richter, Michelle F. et al. Phage-assisted Evolution of an Adenine Base Editor with Improved Cas Domain Compatibility and Activity. Nature Biotechnology 38(7):883-891 (2020).
Rogier, M. et al., Fam72a enforces error-prone DNA repair during antibody diversification, Nature, 2021, vol. 600, pp. 329-333.
Sabatine: PCSK9 Inhibitors: Clinical Evidence and Implementation. Nature Reviews Cardiology vol. 16,3: pp. 155-165 (2019).
Sadowski, M. et al., The sequence-structure relationship and protein function prediction, Current Opinion in Structural Biology, 2009, vol. 19, pp. 357-362.
Seffernick, J. et al., "Melamine Deaminase and Atrazine Chlorohydrolase: 98 Percent Identical but Functionally Different", Journal of Bacteriology, 2001, vol. 183, No. 8, pp. 2405-2410.
Shi, Ke et al. Structural Basis for Targeted DNA Cytosine Deamination and Mutagenesis by APOBEC3A and APOBEC3B. Nature Structural & Molecular Biology vol. 24,2: pp. 131-139 (2017).
Singh et al.: Protein Engineering Approaches in the Post-Genomic Era. Curr Protein Pept Sci. 19(1):5-15 doi:10.2174/1389203718666161117114243 (2018).
Tang et al. Identification of Dehalobacter reductive dehalogenases that catalyse dechlorination of chloroform, 1,1,1-trichloroethane and 1,1-dichloroethane. Philos Trans R Soc Lond B Biol Sci. 368(1616):20120318 (2013).
UniProt Accession No. A0A2K5RDN7:CMP/dCMP-type deaminase domain-containing protein (2018).
UniProt accession No. A0A8S5MVN9, pp. 1-2 (Oct. 12, 2022).
UniProt accession No. A0A8S5N1W0, pp. 1-2 (Oct. 12, 2022).
UniProt accession No. A0A8S5UMQ3, pp. 1-2 (Oct. 12, 2022).
U.S. Appl. No. 17/841,082 Final Office Action dated Apr. 25, 2023.
U.S. Appl. No. 17/841,082 Non-Final Office Action dated Dec. 20, 2022.
U.S. Appl. No. 17/841,082 Office Action dated Dec. 7, 2023.
Witkowski et al., Conversion of a beta-ketoacyl synthase to a malonyl decarboxylase by replacement of the active-site cysteine with glutamine. Biochemistry. 38(36):11643-11650 (1999).
Wolfe, Aron D et al. The Structure of APOBEC1 and Insights into its RNA and DNA Substrate Selectivity. NAR Cancer vol. 2,4: pp. 1-15 (2020).
Workman, Rachael E et al. A Natural Single-guide RNA Repurposes Cas9 to Autoregulate CRISPR-Cas Expression. Cell vol. 184,3: pp. 675-688 (2021).
Yin, Hao et al. Therapeutic Genome Editing by Combined Viral and Non-viral Delivery of CRISPR System Components in Vivo. Nature Biotechnology vol. 34,3: pp. 328-333 (2016).
Young et al. The Promise and Potential Hazards of Adenovirus Gene Therapy. Gut vol. 48,5: pp. 733-736 (2001).
Yu, Y et al. Cytosine Base Editors with Minimized Unguided DNA and RNA off-Target Events and High on-Target Activity. Nature Communications vol. 2052: pp. 1-10 (2020).
Yuan, Zong et al. Precise Base Editing in Rice, Wheat and Maize with aCas9-cytidine Deaminase Fusion, Nature Biotechnology vol. 35,5: pp. 438-440 (2017).
Zhang, Y. et al. In Vivo Gene Delivery by Nonviral Vectors: Overcoming Hurdles ?. Molecular Therapy vol. 20,7: pp. 1298-1304 (2012).
Hu, Z. et al. A compact Cas9 ortholog from *Staphylococcus auricularis* (SauriCas9) expands the DNA targeting scope. PLOS Biology 18(3): 1-18 (2020).

* cited by examiner

| Candidate | sgRNA sequence | PAM | 1 | 2 | 3 | 4 | 5 | 6 | 7 | 8 | 9 | 10 | 11 | 12 | 13 | 14 | 15 | 16 | 17 | 18 | 19 | 20 | 21 | 22 |
|---|---|---|---|---|---|---|---|---|---|---|---|---|---|---|---|---|---|---|---|---|---|---|---|---|
| MGA1-4 | CGTTTGCCGTCTGAATTTGACC | TGAG | C | G | T | T | T | G | C | C | G | T | C | T | G | A | A | T | T | T | G | A | C | C |
| | GAAGATCAGGATATGTGGCGGA | TGAG | G | A | A | G | A | T | C | A | G | G | A | T | A | T | G | T | G | G | C | G | G | A |
| | ACGGGTAACAGTTTCTTTATGG | CAGG | A | C | G | G | G | T | A | A | C | A | G | T | T | T | C | T | T | T | A | T | G | G |
| MGA1-6 | CGTTGCTGCATAAACCGACTAC | ACAAAT | C | G | T | T | G | C | T | G | C | A | T | A | A | A | C | C | G | A | C | T | A | C |
| | AAAACCCGAAACTGTGGAGCGC | CGAAAT | A | A | A | A | C | C | C | G | A | A | A | C | T | G | T | G | G | A | G | C | G | C |
| | GATTGAAAATGGTCTGCTGCTG | CTGAAC | G | A | T | T | G | A | A | A | A | T | G | G | T | C | T | G | C | T | G | C | T | G |
| MGA3-6 | TACGGGTAACAGTTTCTTTATG | GCAGGGT | T | A | C | G | G | G | T | A | A | C | A | G | T | T | T | C | T | T | T | A | T | G |
| | GCGTTGGCAATTTAACCGCCAG | TCAGGCT | G | C | G | T | T | G | G | C | A | A | T | T | T | A | A | C | C | G | C | C | A | G |
| | CTGAATATCGACGGTTTCCATA | TGGGGAT | C | T | G | A | A | T | A | T | C | G | A | C | G | G | T | T | T | C | C | A | T | A |
| MGA3-7 | CACATTTAATGTTGATGAAAGC | TGGCTAC | C | A | C | A | T | T | T | A | A | T | G | T | T | G | A | T | G | A | A | A | G | C |
| | ACACAAATCAGCGATTTCCATG | TTGCCAC | A | C | A | C | A | A | A | T | C | A | G | C | G | A | T | T | T | C | C | A | T | G |
| | ATGGATGAGCAGACGATGGTGC | AGGATAT | A | T | G | G | A | T | G | A | G | C | A | G | A | C | G | A | T | G | G | T | G | C |
| MGA3-8 | TTCATCTGTGGTGCAACGGGCG | CTGGGTC | T | T | C | A | T | C | T | G | T | G | G | T | G | C | A | A | C | G | G | G | C | G |
| | ACGAGCATCATCCTCTGCATGG | TCAGGTC | A | C | G | A | G | C | A | T | C | A | T | C | C | T | C | T | G | C | A | T | G | G |
| | CGACCCGCATTGACCCTAACGC | CTGGGTC | C | G | A | C | C | C | G | C | A | T | T | G | A | C | C | C | T | A | A | C | G | C |
| MGA4-5 | CACAAATCAGCGATTTCCATGT | TGCCA | C | A | C | A | A | A | T | C | A | G | C | G | A | T | T | T | C | C | A | T | G | T |
| | TGATGAAGCAGAACAACTTTAA | CGCCG | T | G | A | T | G | A | A | G | C | A | G | A | A | C | A | A | C | T | T | T | A | A |
| | AATATTGAAACCCACGGCATGG | TGCCA | A | A | T | A | T | T | G | A | A | A | C | C | C | A | C | G | G | C | A | T | G | G |
| MGA7-1 | GAAGATCAGGATATGTGGCGGA | TGAGCG | G | A | A | G | A | T | C | A | G | G | A | T | A | T | G | T | G | G | C | G | G | A |
| | AACGTCGAAAACCCGAAACTGT | GGAGCG | A | A | C | G | T | C | G | A | A | A | A | C | C | C | G | A | A | A | C | T | G | T |
| | AAACCCACGGCATGGTGCCAAT | GAATCG | A | A | A | C | C | C | A | C | G | G | C | A | T | G | G | T | G | C | C | A | A | T |
| MGA14-1 | TCAAAAAATGGCTTTCGCTACC | TGGAGAGA | T | C | A | A | A | A | A | A | T | G | G | C | T | T | T | C | G | C | T | A | C | C |
| | AAGCAGCGTTGTTGCAGTGCAC | GGCAGATA | A | A | G | C | A | G | C | G | T | T | G | T | T | G | C | A | G | T | G | C | A | C |
| | TCAGCCGGAAAACCTACCGGAT | TGATGGTA | T | C | A | G | C | C | G | G | A | A | A | A | C | C | T | A | C | C | G | G | A | T |
| MGA15-1 | GAAGATCAGGATATGTGGCGGA | TGAGCG | G | A | A | G | A | T | C | A | G | G | A | T | A | T | G | T | G | G | C | G | G | A |
| | AACGTCGAAAACCCGAAACTGT | GGAGCG | A | A | C | G | T | C | G | A | A | A | A | C | C | C | G | A | A | A | C | T | G | T |
| | AAACCCACGGCATGGTGCCAAT | GAATCG | A | A | A | C | C | C | A | C | G | G | C | A | T | G | G | T | G | C | C | A | A | T |
| MGA16-1 | GCCAGCTGGCGTAATAGCGAAG | AGGCCC | G | C | C | A | G | C | T | G | G | C | G | T | A | A | T | A | G | C | G | A | A | G |
| | AGGGTGAAACGCAGGTCGCCAG | CGGCAC | A | G | G | G | T | G | A | A | A | C | G | C | A | G | G | T | C | G | C | C | A | G |
| | CTACGTCTGAACGTCGAAAACC | CGAAAC | C | T | A | C | G | T | C | T | G | A | A | C | G | T | C | G | A | A | A | A | C | C |
| MGA18-1 | AAAACCCGAAACTGTGGAGCGC | CGAAAT | A | A | A | A | C | C | C | G | A | A | A | C | T | G | T | G | G | A | G | C | G | C |
| | GGCAACTCTGGCTCACAGTACG | CGTAGT | G | G | C | A | A | C | T | C | T | G | G | C | T | C | A | C | A | G | T | A | C | G |
| | CCGGAAAACCTACCGGATTGAT | GGTAGT | C | C | G | G | A | A | A | A | C | C | T | A | C | C | G | G | A | T | T | G | A | T |
| ABE8.17m | TTTCTTTCACAGATGTGGAT | TGG | T | T | T | C | T | T | T | C | A | C | A | G | A | T | G | T | G | G | A | T | | |
| | CAGGATATGTGGCGGATGAG | CGG | C | A | G | G | A | T | A | T | G | T | G | G | C | G | G | A | T | G | A | G | | |
| | TGCGAATACGCCCACGCGAT | GGG | T | G | C | G | A | A | T | A | C | G | C | C | C | A | C | G | C | G | A | T | | |

*FIG. 6A*

| Candidate | sgRNA sequence | PAM | 1 | 2 | 3 | 4 | 5 | 6 | 7 | 8 | 9 | 10 | 11 | 12 | 13 | 14 | 15 | 16 | 17 | 18 | 19 | 20 | 21 | 22 |
|---|---|---|---|---|---|---|---|---|---|---|---|---|---|---|---|---|---|---|---|---|---|---|---|---|
| MGC1-4 | CGGCGTTTCATCTGTGGTGCAA | CGGG | C | G | G | C | G | T | T | T | C | A | T | C | T | G | T | G | G | T | G | C | A | A |
| | GCCAGGACAGTCGTTTGCCGTC | TGAA | G | C | C | A | G | G | A | C | A | G | T | C | G | T | T | T | G | C | C | G | T | C |
| | TCAGCCGCGCTGTACTGGAGGC | TGAA | T | C | A | G | C | C | G | C | G | C | T | G | T | A | C | T | G | G | A | G | G | C |
| MGC1-6 | CCCTTCCCAACAGTTGCGCAGC | CTGAAT | C | C | C | T | T | C | C | C | A | A | C | A | G | T | T | G | C | G | C | A | G | C |
| | CTGTCGTCGTCCCCTCAAACTG | GCAGAT | C | T | G | T | C | G | T | C | G | T | C | C | C | C | T | C | A | A | A | C | T | G |
| | CTACGTCTGAACGTCGAAAACC | CGAAAG | C | T | A | C | G | T | C | T | G | A | A | C | G | T | C | G | A | A | A | A | C | C |
| MGC3-6 | GTGACGGCAGTTATCTGGAAGA | TCAGGAT | G | T | G | A | C | G | G | C | A | G | T | T | A | T | C | T | G | G | A | A | G | A |
| | ATGATTTCAGCCGCGCTGTACT | GGAGGGT | A | T | G | A | T | T | T | C | A | G | C | C | G | C | G | C | T | G | T | A | C | T |
| | TTACTGCCGCCTGTTTTGACCG | CTGGGAT | T | T | A | C | T | G | C | C | G | C | C | T | G | T | T | T | T | G | A | C | C | G |
| MGC3-7 | CGAATGGCGCTTTGCCTGGTTT | CCGGCAC | C | G | A | A | T | G | G | C | G | C | T | T | T | G | C | C | T | G | G | T | T | T |
| | TCCCCTCAAACTGGCAGATGCA | CGGTTAC | T | C | C | C | C | T | C | A | A | A | C | T | G | G | C | A | G | A | T | G | C | A |
| | ATCTACACCAACGTGACCTATC | CCATTAC | A | T | C | T | A | C | A | C | C | A | A | C | G | T | G | A | C | C | T | A | T | C |
| MGC3-8 | TTCATCTGTGGTGCAACGGGCG | CTGGGTC | T | T | C | A | T | C | T | G | T | G | G | T | G | C | A | A | C | G | G | G | C | G |
| | ACGAGCATCATCCTCTGCATGG | TCAGGTC | A | C | G | A | G | C | A | T | C | A | T | C | C | T | C | T | G | C | A | T | G | G |
| | CGACCCGCATTGACCCTAACGC | CTGGGTC | C | G | A | C | C | C | G | C | A | T | T | G | A | C | C | C | T | A | A | C | G | C |
| MGC4-5 | CAACGGGCGCTGGGTCGGTTAC | GGCCA | C | A | A | C | G | G | G | C | G | C | T | G | G | G | T | C | G | G | T | T | A | C |
| | CACAAATCAGCGATTTCCATGT | TGCCA | C | A | C | A | A | A | T | C | A | G | C | G | A | T | T | T | C | C | A | T | G | T |
| | AAGGCGGCGGAGCCGACACCAC | GGCCA | A | A | G | G | C | G | G | C | G | G | A | G | C | C | G | A | C | A | C | C | A | C |
| MGC7-1 | GCCGATCGCGTCACACTACGTC | TGAACG | G | C | C | G | A | T | C | G | C | G | T | C | A | C | A | C | T | A | C | G | T | C |
| | GATCCGCGCTGGCTACCGGCGA | TGAGCG | G | A | T | C | C | G | C | G | C | T | G | G | C | T | A | C | C | G | G | C | G | A |
| | CCTTCCCGCCCGGTGCAGTATG | AAGGCG | C | C | T | T | C | C | C | G | C | C | C | G | G | T | G | C | A | G | T | A | T | G |
| MGC14-1 | CGGTCAATCCGCCGTTTGTTCC | CACGGAGA | C | G | G | T | C | A | A | T | C | C | G | C | C | G | T | T | T | G | T | T | C | C |
| | TCCTTTGCGAATACGCCCACGC | GATGGGTA | T | C | C | T | T | T | G | C | G | A | A | T | A | C | G | C | C | C | A | C | G | C |
| | GGTCGGCTTACGGCGGTGATTT | TGGCGATA | G | G | T | C | G | G | C | T | T | A | C | G | G | C | G | G | T | G | A | T | T | T |
| MGC15-1 | GCCGATCGCGTCACACTACGTC | TGAACG | G | C | C | G | A | T | C | G | C | G | T | C | A | C | A | C | T | A | C | G | T | C |
| | GATCCGCGCTGGCTACCGGCGA | TGAGCG | G | A | T | C | C | G | C | G | C | T | G | G | C | T | A | C | C | G | G | C | G | A |
| | CCTTCCCGCCCGGTGCAGTATG | AAGGCG | C | C | T | T | C | C | C | G | C | C | C | G | G | T | G | C | A | G | T | A | T | G |
| MGC16-1 | ACGTGACCTATCCCATTACGGT | CAATCC | A | C | G | T | G | A | C | C | T | A | T | C | C | C | A | T | T | A | C | G | G | T |
| | ATCCGCCGTTTGTTCCCACGGA | GAATCC | A | T | C | C | G | C | C | G | T | T | T | G | T | T | C | C | C | A | C | G | G | A |
| | CGACGGCACGCTGATTGAAGCA | GAAGCC | C | G | A | C | G | G | C | A | C | G | C | T | G | A | T | T | G | A | A | G | C | A |
| MGC18-1 | TCAGCCGCGCTGTACTGGAGGC | TGAAGT | T | C | A | G | C | C | G | C | G | C | T | G | T | A | C | T | G | G | A | G | G | C |
| | GACCAGCCCTTCCCGGCTGTGC | CGAAAT | G | A | C | C | A | G | C | C | C | T | T | C | C | C | G | G | C | T | G | T | G | C |
| | TCCGTTTATCCGGGCAAACCAT | CGAAGT | T | C | C | G | T | T | T | A | T | C | C | G | G | G | C | A | A | A | C | C | A | T |
| BE3 | CCTCTGGATGTCGCTCCACA | AGG | C | C | T | C | T | G | G | A | T | G | T | C | G | C | T | C | C | A | C | A | | |
| | GGGACGCGCGAATTGAATTA | TGG | G | G | G | A | C | G | C | G | C | G | A | A | T | T | G | A | A | T | T | A | | |
| | CGTTTTACAACGTCGTGACT | GGG | C | G | T | T | T | T | A | C | A | A | C | G | T | C | G | T | G | A | C | T | | |

FIG. 6B

Base edit occurs at A2 position of the template strand.

| sgRNA | TadA variant | Tested/edited |
|---|---|---|
| - | TadA | 0/10 |
| + | TadA | 1/10 |
| | TadA (D108N) | 7/9 |
| | TadA (ABE8.17m) | 10/10 |

| sgRNA | TadA variant | Tested/edited |
|---|---|---|
| - | EcTadA | 1/0 |
| + | EcTadA | 12/0 |
| | MG68-1 | 4/0 |
| | MG68-2 | 8/0 |
| | MG68-3 | 8/2 |
| | MG68-4 | 11/3 |
| | MG68-5 | 8/0 |
| | MG68-6 | 5/0 |
| | MG68-7 | 6/0 |
| | MG68-8 | 1/1 |

*FIG. 16B*

| Gene | Tested/edited |
|---|---|
| MG68-4 | 12/4 |
| MG68-4 (D109N) | 13/13 |

| sgRNA | Tested/edited |
|---|---|
| - | 0/0 |
| + | 7/7 |

| MG68-4 | 24 | 83 | 85 | 107 | 109 | 112 | 124 | 143 | 147 | 148 | 154 | 158 |
|---|---|---|---|---|---|---|---|---|---|---|---|---|
| | W | V | L | A | D | T | H | A | S | D | R | K |
| MG68-4_V1 | | | | | N | | | | | | | |
| MG68-4_V2 | | | | V | N | | | | | | | |
| MG68-4_V3 | | | | | N | | | | | Y | | |
| MG68-4_V4 | | | F | | N | | | | | | | |
| MG68-4_V5 | | | | | N | | Y | | | | | |
| MG68-4_V6 | | | | | N | | | N | | | | |
| MG68-4_V7 | | | | | N | | | | C | | | |
| MG68-4_V8 | | | | | N | | | | | | | N |
| MG68-4_V9 | R | | | | N | | | | | | | |
| MG68-4_V10 | | S | | | N | | | | | | | |
| MG68-4_V11 | | | | | N | R | | | | | | |
| MG68-4_V12 | | | | | N | | | | | R | | |
| MG68-4_V13 | | | | | N | | | | | | P | |
| MG68-4_V14 | | | | V | N | | | | | Y | | |
| MG68-4_V15 | | | F | V | N | | | | | Y | | |
| MG68-4_V16 | | | F | V | N | | Y | | | | | |
| MG68-4_V17 | | | F | V | N | | Y | N | | Y | | |
| MG68-4_V18 | | | F | V | N | | Y | | C | Y | | |
| MG68-4_V19 | | | F | V | N | | Y | | | Y | | N |
| MG68-4_V20 | | | F | V | N | | Y | | C | Y | | N |
| MG68-4_V21 | R | | F | V | N | | Y | | C | Y | | N |
| MG68-4_V22 | R | | F | V | N | | Y | N | C | Y | | N |
| MG68-4_V23 | R | | F | V | N | | Y | N | C | Y | P | N |
| MG68-4_V24 | R | S | F | V | N | | Y | N | C | Y | P | N |
| MG68-4_V25 | R | S | F | V | N | | H | N | C | Y | P | N |
| MG68-4_V26 | R | S | F | V | N | | H | N | C | R | P | N |
| MG68-4_V27 | R | S | F | V | N | R | H | N | C | R | P | N |
| MG68-4_V28 | R | S | F | V | N | R | H | N | C | D | P | N |

*FIG. 19*

BASE EDITING ENZYMES

CROSS-REFERENCE

This application is a continuation of International Application No. PCT/US2022/079345, filed on Nov. 4, 2022, which claims the benefit of U.S. Provisional Application Nos.: 63/276,461, filed on Nov. 5, 2021; 63/289,998, filed on Dec. 15, 2021; 63/342,824, filed on May 17, 2022; 63/356,888, filed on Jun. 29, 2022; and 63/378,171, filed on Oct. 3, 2022; each of which is entitled "BASE EDITING ENZYMES" and is incorporated herein by reference in its entirety. This application is related to PCT Patent Application No. PCT/US2021/049962, which is incorporated by reference herein in its entirety.

BACKGROUND

Cas enzymes along with their associated Clustered Regularly Interspaced Short Palindromic Repeats (CRISPR) guide ribonucleic acids (RNAs) appear to be a pervasive (~45% of bacteria, ~84% of archaea) component of prokaryotic immune systems, serving to protect such microorganisms against non-self nucleic acids, such as infectious viruses and plasmids by CRISPR-RNA guided nucleic acid cleavage. While the deoxyribonucleic acid (DNA) elements encoding CRISPR RNA elements may be relatively conserved in structure and length, their CRISPR-associated (Cas) proteins are highly diverse, containing a wide variety of nucleic acid-interacting domains. While CRISPR DNA elements have been observed as early as 1987, the programmable endonuclease cleavage ability of CRISPR complexes has only been recognized relatively recently, leading to the use of recombinant CRISPR systems in diverse DNA manipulation and gene editing applications.

SEQUENCE LISTING

The instant application contains a Sequence Listing which has been submitted electronically in XML format and is hereby incorporated by reference in its entirety. The XML copy, created on Dec. 10, 2024, is named 55921-742_301_SL.xml and is 2,854,718 bytes in size.

SUMMARY

In some aspects, the present disclosure provides for a method of deaminating a cytosine residue in a eukaryotic nucleic acid sequence in a cell, comprising: contacting to said eukaryotic nucleic acid sequence a polypeptide with cytidine deaminase activity comprising a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1-49, 444-447, 599-675, 744-835, 970-982, or a variant thereof. In some embodiments, said eukaryotic nucleic acid sequence is a mammalian, primate, or human nucleic acid sequence. In some embodiments, said cell is a mammalian, primate, or human cell. In some embodiments, said eukaryotic nucleic acid sequence comprises single-stranded DNA (ssDNA) or ribonucleic acid (RNA). In some embodiments, said polypeptide with cytidine deaminase activity comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 809-811, 819, 826, 752, 777, 823, 668-671, 675, 650, 752, 774, 777, 806, 812, 816, 817, 818, 825, 827, 832, 970-982, or a variant thereof. In some embodiments, said polypeptide with cytidine deaminase activity comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 808, 810-811, 819, 826, 752, 777, or 823, or a variant thereof. In some embodiments, said eukaryotic nucleic acid sequence comprises double-stranded DNA (dsDNA). In some embodiments, said polypeptide with cytidine deaminase activity comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 810-811. In some embodiments, said polypeptide with cytidine deaminase activity further comprises a nucleic acid binding domain, an endonuclease, or a nickase. In some embodiments, said polypeptide with cytidine deaminase activity further comprises said endonuclease or said nickase, wherein said endonuclease or said nickase comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, 1120, 1122-1127, 1647, or a variant thereof. In some embodiments, said polypeptide with cytidine deaminase activity further comprises a nickase, wherein said nickase comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof. In some embodiments, said polypeptide with cytidine deaminase activity further comprises a uracil DNA glycosylase inhibitor sequence. In some embodiments, said uracil DNA glycosylase inhibitor comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 52-56 or SEQ ID NO: 67, or a variant thereof. In some embodiments, said polypeptide with cytidine deaminase activity further comprises a FAM72A sequence. In some embodiments, said FAM72A sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 1121, or a variant thereof.

In some aspects, the present disclosure provides for a method of deaminating a cytosine residue in a primate nucleic acid sequence in a cell, comprising: contacting to a primate nucleic acid sequence a polypeptide with cytidine deaminase activity comprising a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 599-638, 660-675, 828-835, or a variant thereof. In some embodiments, said eukaryotic nucleic acid sequence comprises double-stranded DNA (dsDNA), single-stranded DNA (ssDNA) or ribonucleic acid (RNA). In some embodiments, said polypeptide with cytidine deaminase activity further comprises a nucleic acid binding domain, an endonuclease, or a nickase. In some embodiments, said polypeptide with cytidine deaminase activity further comprises said endonuclease or said nickase, wherein said endonuclease or said nickase comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, 1120, 1122-1127, 1647, or a variant thereof. In some embodiments, said polypeptide with cytidine deaminase activity further comprises a nickase, wherein said nickase comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof. In some embodiments, said polypeptide with cytidine deaminase activity further comprises a uracil DNA glycosylase inhibitor sequence. In some embodiments, said uracil DNA glycosylase inhibitor comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 52-56 or SEQ ID NO: 67, or a variant thereof. In some embodiments, said polypeptide with cytidine deaminase activity further comprises a FAM72A sequence. In some embodiments, said FAM72A sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 1121, or a variant thereof.

In some aspects, the present disclosure provides for a nucleic acid comprising an engineered nucleic acid sequence optimized for expression in a mammalian organism, wherein said nucleic acid encodes a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1-49, 444-447, 599-675, 744-835, 970-982, or a variant thereof. In some embodiments, said nucleic acid encodes a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 809-811, 819, 826, 752, 777, 823, 668-671, 675, 650, 752, 774, 777, 806, 812, 816, 817, 818, 825, 827, 832, 832, 970-982, or a variant thereof.

In some aspects, the present disclosure provides for a nucleic acid encoding any of the polypeptides described herein.

In some aspects, the present disclosure provides for a vector comprising any of the nucleic acids described herein.

In some aspects, the present disclosure provides for a fusion polypeptide comprising: (a) a domain with cytidine deaminase activity comprising a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1-49, 444-447, 599-675, 744-835, 970-982, or a variant thereof; and (b) a nucleic acid binding domain, an endonuclease domain, or a nickase domain. In some embodiments, said domain with cytidine deaminase activity comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 809-811, 819, 826, 752, 777, 823, 668-671, 675, 650, 752, 774, 777, 806, 812, 816, 817, 818, 825, 827, 832, 832, 970-982, or a variant thereof. In some embodiments, said domain with cytidine deaminase activity comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 809-811, 819, 826, 752, 777, 823, or a variant thereof. In some embodiments, said fusion polypeptide comprises said endonuclease domain or said nickase domain, wherein said endonuclease domain or said nickase domain comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, 1122-1127, 1647, or a variant thereof. In some embodiments, said fusion protein comprises said nickase domain, wherein said nickase domain comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof. In some embodiments, said fusion protein comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 877-916 or 968-969, or a variant thereof.

In some aspects, the present disclosure provides for system comprising: (a) any of the fusion proteins (e.g. endonuclease-base editor or endonuclease-deaminase fusions); and (b) an engineered guide polynucleotide configured to form a complex with said endonuclease domain comprising: (i) a guide ribonucleic acid sequence configured to hybridize to a target deoxyribonucleic acid sequence; and (ii) a ribonucleic acid sequence configured to bind to said endonuclease domain. In some embodiments, said engineered guide polynucleotide further comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to non-degenerate nucleotides of any one of SEQ ID NOs: 88-96, 917-931, 963-967, 1099-1105, or a variant thereof.

In some aspects, the present disclosure provides for a polypeptide with adenosine deaminase activity comprising: a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 50, 51, 385-443, 448-475, or a variant thereof, wherein said polypeptide comprises a substitution at least one of residues T2, D7, E10, M13, W24, G32, K38, G45, G51, A63, E66, R75, C91, G93, H97, A107, E108, D109, P110, H124, A126, H129, F150, or S165, or any combination thereof relative to SEQ ID NO: 50 when optimally aligned. In some embodiments, said substitution comprises $T2X_1$, $D7X_1$, $E10X_1$, $M13X_4$, $W24X_1$, $G32X_1$, $K38X_2$, $G45X_2$, $G51X_5$, $A63X_7$, $E66X_5$, $E66X_2$, R75H, C91R, $G93X_6$, $H97X_6$, $H97X_5$, $A107X_5$, $E108X_2$, D109N, P110H, $H124X_6$, $A126X_2$, H129R, H129N, F150P, F150S, $S165X_5$, or any combination thereof relative to SEQ ID NO: 50 or MG68-4 when optimally aligned, wherein $X_1$ is A or G; $X_2$ is D or E; $X_3$ is N or Q; $X_4$ is R or K; $X_5$ is I, L, M, or V; $X_6$ is F, Y, or W; and $X_7$ is S or T. In some embodiments, said polypeptide comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 836-860, or a variant thereof. In some embodiments, said polypeptide comprises any one of SEQ ID NOs: 839, 841, 843, 844, 847, 848, 849, 850, 851, 852, 859, or a variant thereof. In some embodiments, said substitution comprises W24G, G51V, E108D, P110H, F150P, D7G, E10G, or H129N, or any combination thereof, relative to SEQ ID NO: 50 or MG68-4 when optimally aligned. In some embodiments, said polypeptide further comprises a nucleic acid binding domain, an endonuclease domain, or a nickase domain. In some embodiments, said polypeptide comprises said endonuclease domain or said nickase domain, wherein said endonuclease domain or said nickase domain comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, 1122-1127, 1647, or a variant thereof. In some embodiments, said polypeptide comprises said nickase domain, wherein said nickase domain comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof.

In some aspects, the present disclosure provides for a system comprising: (a) any of the polypeptides or fusion polypeptides described herein; and (b) an engineered guide polynucleotide configured to form a complex with said endonuclease domain comprising: (i) a guide ribonucleic acid sequence configured to hybridize to a target deoxyribonucleic acid sequence; and (ii) a ribonucleic acid sequence configured to bind to said endonuclease domain. In some embodiments, said engineered guide polynucleotide further comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to non-degenerate nucleotides of any one of SEQ ID NOs: 88-96, 917-931, 963-967, 1099-1105, or a variant thereof;

In some aspects, the present disclosure provides for a method of deaminating a cytosine residue in a cell, comprising introducing to said cell: (a) a vector encoding a polypeptide with cytidine deaminase activity; and (b) a vector encoding a FAM72A protein. In some embodiments, said vector encoding said FAM72A protein comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 1115, or a variant thereof, or encodes a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 1121, or a variant thereof. In some embodiments, said polypeptide with cytidine deaminase activity comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1-49, 444-447, 599-675, 744-835, 970-982, or a variant thereof. In some embodiments, said polypeptide with cytidine deaminase activity further comprises a nucleic acid binding domain, an endonuclease domain, or a nickase domain. In some embodiments, said polypeptide with cytidine deaminase activity comprises said endonuclease domain or said nickase domain, wherein said endonuclease domain or said nickase domain comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, 1122-1127, 1647, or a variant thereof. In some embodiments, said polypeptide with cytidine deaminase activity comprises said nickase domain, wherein said nickase domain comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof.

In some aspects, the present disclosure provides for an engineered nucleic acid editing polypeptide, comprising (i) a sequence with cytidine deaminase activity; and (ii) a sequence derived from a FAM72A protein. In some embodiments, said sequence with cytidine deaminase activity has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1-49, 444-447, 599-675, 744-835, 970-982, or a variant thereof. In some embodiments, said sequence derived from said FAM72A protein has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 1121, or a variant thereof. In some embodiments, the polypeptide further comprises an endonuclease sequence comprising a RuvC domain and an HNH domain, wherein said endonuclease sequence is a sequence of a class 2, type II endonuclease. In some embodiments, said RuvC domain lacks nuclease activity. In some embodiments, said endonuclease comprises a nickase. In some embodiments, said class 2, type II endonuclease sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, 1122-1127, 1647, or a variant thereof. In some embodiments, said class 2, type II endonuclease comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597 when optimally aligned.

In some aspects, the present disclosure provides for a method of editing a cytosine residue to a thymine residue in a cell, comprising contacting to said cell any of the cytidine deaminase fusion polypeptides described herein. In some embodiments, said cell is a prokaryotic, eukaryotic, mammalian, primate, or human cell.

In some aspects, the present disclosure provides for an engineered nucleic acid editing polypeptide, comprising: a plurality of domains derived from a Class 2, Type II endonuclease, wherein said domains comprise RUVC-I, REC, HNH, RUVC-III, and WED domains; and a domain comprising a base editor sequence, wherein said base editor sequence is inserted: (a) within said RUVC-I domain; (b) within said REC domain; (c) within said HNH domain; (d) within said RUV-CIII domain; (e) within said WED domain; (f) prior to said HNH domain; (g) prior to said RUV-CIII domain; or (h) between said RUVC-III and said WED domain. In some embodiments, said Class 2, Type II endonuclease comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, 1122-1127, 1647, or a variant thereof. In some embodiments, said Class 2, Type II endonuclease comprises a sequence having at least 80% sequence identity to SEQ ID NO: 1647, or a variant thereof. In some embodiments, said base editor sequence comprises a deaminase sequence. In some embodiments, said deaminase sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1-49, 444-447, 599-675, 744-835, 970-982, 50, 51, 385-443, 448-475, or a variant thereof. In some embodiments, said deaminase sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1-49, 444-447, 599-675, 744-835, 970-982, or a variant thereof. In some embodiments, said deaminase sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 50, 51, 385-443, 448-475, or a variant thereof. In some embodiments, said deaminase has at least 80% sequence identity to SEQ ID NO: 386, or a variant thereof. In some embodiments, said deaminase sequence comprises a substitution of one of residues T2, D7, E10, M13, W24, G32, K38, G45, G51, A63, E66, R75, C91, G93, H97, A107, E108, D109, P110, H124, A126, H129, F150, or S165, or any combination thereof relative to SEQ ID NO: 50 or MG68-4 when optimally aligned. In some embodiments, said engineered nucleic acid editing polypeptide comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1128-1160, or a variant thereof. In some embodiments, said engineered nucleic acid editing polypeptide comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1137, 1140, 1142, 1143, 1146, 1149, 1151-1158, or a variant thereof. In some embodiments, said engineered nucleic acid editing polypeptide comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1139,1152,1158, or a variant thereof.

In some aspects, the present disclosure provides for polypeptide with adenosine deaminase activity comprising: a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 50, 51, 385-443, 448-475, or a variant thereof, wherein said polypeptide comprises a substitution of a wild-type residue for a non-wild-type residue at residue 109 and one other residue comprising any one of 24, 37, 49, 52, 83, 85, 107, 110, 112, 120, 123, 124, 147, 148, 150, 156, 157, 158, 166, 167, or 129, or any combination thereof relative to SEQ ID NO: 386 when optimally aligned. In some embodiments, said sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 386. In some embodiments, the polypeptide comprises a substitution of 109N and at least one other substitution comprising any one of 24R, 37L, 49A, 52L, 83S, 85F, 107V, 110,S 112R, 120N, 123N, 124Y, 147C, 148Y, 148R, 150Y, 156V, 157F, 158N, 1661, or 129N, or any combination thereof relative to SEQ ID NO: 386 when optimally aligned. In some embodiments, the peptide comprises any of the substitutions depicted in FIG. 34B. In some embodiments, said polypeptide has at least 80% sequence identity to any one of SEQ ID NOs: 1161-1183, or a variant thereof. In some embodiments, said polypeptide has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1170, 1179, or 1166, or a variant thereof. In some embodiments, said polypeptide further comprises an endonuclease or a nickase. In some embodiments, said polypeptide comprises said endonuclease or said nickase, wherein said endonuclease or said nickase comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, 1122-1127, 1647, or a variant thereof. In some embodiments, said polypeptide comprises said nickase, wherein said nickase comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof.

In some aspects, the present disclosure provides for a polypeptide with cytidine deaminase activity comprising: a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1-49, 444-447, 599-675, 744-835, 970-982, or a variant thereof; wherein said polypeptide comprises at least one of the alterations described in Table 12C. In some embodiments, said polypeptide has at least one substitution of a wild-type amino acid for a non-wild-type amino acid comprising any one of W90A, W90F, W90H, W90Y, Y120F, Y120H, Y121F, Y121H, Y121Q, Y121A, Y121D, Y121W, H122Y, H122F, H1221, H122A, H122W, H122D, Y121T, R33A, R34A, R34K, H122A, R33A, R34A, R52A, N57G, H122A, E123A, E123Q, W127F, W127H, W127Q, W127A, W127D, R39A, K40A, H128A, N63G, R58A, H121F, H121Y, H121Q, H121A, H121D, H121W, R33A, K34A, H122A, H121A, R52A, P26R, P26A, N27R, N27A, W44A, W45A, K49G, S50G, R51G, R121A, I122A, N123A, Y88F, Y120F, P22R, P22A, K23A, K41R, K41A, E54A, E54A, E55A, K30A, K30R, M32A, M32K, Y117A, K118A, 1119A, 1119H, R120A, R121A, P46A, P46R, N29A, R27A, or N50G, or any combination thereof, optionally relative to an APOBEC polypeptide. In some embodiments, the polypeptide comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1208-1315, or a variant thereof.

In some aspects, the present disclosure provides for a polypeptide with cytidine deaminase activity comprising: a cytidine deaminase sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 835, 1275, 668, 774, 818, 671, 667, 650, 827, 819, 823, 814, 813, 817, 628, 826, 1223, 834, 618, 621, 669, 833, 830, or a variant thereof; and an endonuclease or a nickase. In some embodiments, said endonuclease or said nickase comprises a sequence having at least 80% identity to any one of SEQ ID NOs: 70-78, 596, 597, Sequence Number: A598, SEQ ID NOs: 1120, or 1122-1127, 1647, or a variant thereof. In some embodiments, said polypeptide comprises said nickase, wherein said nickase comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof. In some embodiments, said cytidine deaminase sequence has at least 80% sequence identity to any one of SEQ ID NOs: 1275, 835, or 774, or a combination thereof.

In some aspects, the present disclosure provides for a polypeptide with adenosine deaminase activity comprising: a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 50, 51, 385-443, 448-475, 1015-1098, or a variant thereof, wherein said polypeptide comprises any of the combinations of substitutions of a wild-type residue for a non-wild-type residue recited in Table 12D. In some embodiments, said polypeptide has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1556-1638, or a variant thereof. In some embodiments, said polypeptide further comprises an endonuclease or a nickase. In some embodiments, said polypeptide comprises said endonuclease or said nickase, wherein said endonuclease or said nickase comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, or 1122-1127, 1647, or a variant thereof. In some embodiments, said polypeptide comprises said nickase, wherein said nickase comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof.

In some aspects, the present disclosure provides for a polypeptide with adenosine deaminase activity comprising: a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 50, 51, 385-443, 448-475, 1015-1098, or a variant thereof, wherein said polypeptide comprises any of the combinations of substitutions of a wild-type residue for a non-wild-type residue recited in Table 13. In some embodiments, said sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 386, or a variant thereof. In some embodiments, said polypeptide further comprises an endonuclease or a nickase. In some embodiments, said polypeptide comprises said endonuclease or said nickase, wherein said endonuclease or said nickase comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, or 1122-1127, 1647, or a variant thereof. In some embodiments, said polypeptide comprises said nickase, wherein said nickase comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof.

In some aspects, the present disclosure provides for a method of editing an APOA1 locus in a cell, comprising contacting to said cell (a) an RNA-guided endonuclease; and (b) an engineered guide nucleic acid structure, wherein said engineered guide nucleic acid structure is configured to form a complex with said endonuclease and said engineered guide nucleic acid structure comprises a spacer sequence configured to hybridize to a region of said APOA1 locus, wherein said engineered guide nucleic acid structure comprises a targeting sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to at least 18, 19, 20, 21, 22, 23, 24, 25, or 26 consecutive nucleotides of any one of SEQ ID NOs: 1455-1478 or a reverse complement thereof. In some embodiments, said engineered guide nucleic acid structure has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1431-1454. In some embodiments, said engineered guide nucleic acid structure comprises any of the nucleotide modifications recited in Table 13A. In some embodiments, said RNA-guided endonuclease is a class 2, type II endonuclease. In some embodiments, said RNA-guided endonuclease has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, 1122-1127, 1647, or a variant thereof.

In some aspects, the present disclosure provides for a method of editing an ANGPTL3 locus in a cell, comprising contacting to said cell (a) an RNA-guided endonuclease; and (b) an engineered guide nucleic acid structure, wherein said engineered guide nucleic acid structure is configured to form a complex with said endonuclease and said engineered guide nucleic acid structure comprises a spacer sequence configured to hybridize to a region of said ANGPTL3 locus, wherein said engineered guide nucleic acid structure comprises a targeting sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to at least 18, 19, 20, 21, 22, 23, 24, 25, or 26 consecutive nucleotides of any one of SEQ ID NOs: 1484-1488 or a reverse complement thereof. In some embodiments, said engineered guide nucleic acid structure has at least 80% identity to any one of SEQ ID NOs: 1479-1483. In some embodiments, said engineered guide nucleic acid structure comprises any of the nucleotide modifications recited in Table 13A. In some embodiments, said RNA-guided endonuclease is a class 2, type II endonuclease. In some embodiments, said RNA-guided endonuclease has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, 1122-1127, 1647, or a variant thereof.

In some aspects, the present disclosure provides for a method of editing a TRAC locus in a cell, comprising contacting to said cell (a) an RNA-guided endonuclease; and (b) an engineered guide nucleic acid structure, wherein said engineered guide nucleic acid structure is configured to form a complex with said endonuclease and said engineered guide nucleic acid structure comprises a spacer sequence configured to hybridize to a region of said TRAC locus, wherein said engineered guide nucleic acid structure comprises a targeting sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to at least 18, 19, 20, 21, 22, 23, 24, 25, or 26 consecutive nucleotides of any one of SEQ ID NOs: 1491-1492 or a reverse complement thereof. In some embodiments, said engineered guide nucleic acid structure has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1489-1490. In some embodiments, aid engineered guide nucleic acid structure comprises any of the nucleotide modifications recited in Table 13A. In some embodiments, said RNA-guided endonuclease is a class 2, type II endonuclease. In some embodiments, said RNA-guided endonuclease has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, 1122-1127, 1647, or a variant thereof.

In some aspects, the present disclosure provides for an engineered adenosine base editor polypeptide, wherein said polypeptide comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1647-1653.

In some aspects, the present disclosure provides for a method of deaminating a cytosine residue in a eukaryotic nucleic acid sequence in a cell, comprising: contacting to said eukaryotic nucleic acid sequence a polypeptide with cytidine deaminase activity comprising a sequence having at least at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1-49, 444-447, 599-675, 744-835, 970-982, or a variant thereof. In some embodiments, said eukaryotic nucleic acid sequence is a mammalian, primate, or human nucleic acid sequence. In some embodiments, said cell is a mammalian, primate, or human cell. In some embodiments, said eukaryotic nucleic acid sequence comprises single-stranded DNA (ssDNA) or ribonucleic acid (RNA). In some embodiments, said polypeptide with cytidine deaminase activity comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 809-811, 819, 826, 752, 777, 823, 668-671, 675, 650, 752, 774, 777, 806, 812, 816, 817, 818, 825, 827, 832, 970-982, or a variant thereof. In some embodiments, said polypeptide with cytidine deaminase activity comprises a sequence having at least 80% identity to any one of SEQ ID NOs: 808, 810-811, 819, 826, 752, 777, or 823, or a variant thereof. In some embodiments, said eukaryotic nucleic acid sequence comprises double-stranded DNA (dsDNA). In some embodiments, said polypeptide with cytidine deaminase activity comprises a sequence having at least 80% identity to any one of SEQ ID NOs: 810-811. In some embodiments, said polypeptide with cytidine deaminase activity further comprises a nucleic acid binding domain, an endonuclease, or a nickase. In some embodiments, said polypeptide with cytidine deaminase activity further comprises said endonuclease or said nickase, wherein said endonuclease or said nickase comprises a sequence having at least 80%, at least 810%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, 1120, or 1122-1127, or a variant thereof. In some embodiments, said polypeptide with cytidine deaminase activity further comprises a nickase, wherein said nickase comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof. In some embodiments, said polypeptide with cytidine deaminase activity further comprises a uracil DNA glycosylase inhibitor sequence. In some embodiments, said uracil DNA glycosylase inhibitor comprises a sequence with at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 52-56 or SEQ ID NO: 67, or a variant thereof. In some embodiments, said polypeptide with cytidine deaminase activity further comprises a FAM72A sequence. In some embodiments, said FAM72A sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 1121, or a variant thereof.

In some aspects, the present disclosure provides for a method of deaminating a cytosine residue in a primate nucleic acid sequence in a cell, comprising: contacting to said primate nucleic acid sequence a polypeptide with cytidine deaminase activity comprising a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 599-638, 660-675, or 828-835, or a variant thereof. In some embodiments, said eukaryotic nucleic acid sequence comprises double-stranded DNA (dsDNA), single-stranded DNA (ssDNA) or ribonucleic acid (RNA). In some embodiments, said polypeptide with cytidine deaminase activity further comprises a nucleic acid binding domain, an endonuclease, or a nickase. In some embodiments, said polypeptide with cytidine deaminase activity further comprises said endonuclease or said nickase, wherein said endonuclease or said nickase comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity identity to any one of SEQ ID NOs: 70-78, 596, 597, 1120, or 1122-1127, or a variant thereof. In some embodiments, said polypeptide with cytidine deaminase activity further comprises a nickase, wherein said nickase comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof. In some embodiments, said polypeptide with cytidine deaminase activity further comprises a uracil DNA glycosylase inhibitor sequence. In some embodiments, said uracil DNA glycosylase inhibitor comprises a sequence with at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 52-56 or SEQ ID NO: 67, or a variant thereof. In some embodiments, said polypeptide with cytidine deaminase activity further comprises a FAM72A sequence. In some embodiments, said FAM72A sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to SEQ ID NO: 1121, or a variant thereof.

In some aspects, the present disclosure provides for a nucleic acid comprising an engineered nucleic acid sequence optimized for expression in a mammalian organism, wherein said nucleic acid encodes a sequence having at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 1-49, 444-447, 599-675, 744-835, 970-982, or a variant thereof. In some embodiments, said nucleic acid encodes a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 809-811, 819, 826, 752, 777, 823, 668-671, 675, 650, 752, 774, 777, 806, 812, 816, 817, 818, 825, 827, 832, 832, 970-982, or a variant thereof.

In some aspects, the present disclosure provides for a vector comprising any of the nucleic acids described herein. In some embodiments, the vector is a non-viral or a viral vector. In some embodiments the vector is a plasmid, minicircle, or plasmid vector. In some embodiments, the viral vector is an AAV vector.

In some aspects, the present disclosure provides for a fusion polypeptide comprising: (a) a domain with cytidine deaminase activity comprising a sequence having at least 80% identity to any one of SEQ ID NOs: 1-49, 444-447, 599-675, 744-835, 970-982, or a variant thereof; and (b) a nucleic acid binding domain, an endonuclease domain, or a nickase domain. In some embodiments, said domain with cytidine deaminase activity comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 809-811, 819, 826, 752, 777, 823, 668-671, 675, 650, 752, 774, 777, 806, 812, 816, 817, 818, 825, 827, 832, 832, 970-982, or a variant thereof. In some embodiments, said domain with cytidine deaminase activity comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 809-811, 819, 826, 752, 777, 823, or a variant thereof. In some embodiments, said fusion polypeptide comprises said endonuclease domain or said nickase domain, wherein said endonuclease domain or said nickase domain comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, or 1122-1127, or a variant thereof. In some embodiments, said fusion protein comprises said nickase domain, wherein said nickase domain comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof. In some embodiments, said fusion protein comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 877-916 or 968-969, or a variant thereof.

In some aspects, the present disclosure provides for a system comprising: (a) any of the the fusion polypeptides described herein; and (b) an engineered guide polynucleotide configured to form a complex with said endonuclease domain comprising: (i) a guide ribonucleic acid sequence configured to hybridize to a target deoxyribonucleic acid sequence; and (ii) a ribonucleic acid sequence configured to bind to said endonuclease domain. In some embodiments, said engineered guide polynucleotide further comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to non-degenerate nucleotides of any one of SEQ ID NOs: 88-96, 917-931, 963-967, or 1099-1105, or a variant thereof.

In some aspects, the present disclosure provides for a polypeptide with adenosine deaminase activity comprising: a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 50, 51, 385-443, 448-475, or a variant thereof, wherein said polypeptide comprises a substitution at least one of residues T2, D7, E10, M13, W24, G32, K38, G45, G51, A63, E66, R75, C91, G93, H97, A107, E108, D109, P110, H124, A126, H129, F150, or S165, or any combination thereof relative to SEQ ID NO: 50 when optimally aligned. In some embodiments, said substitution comprises $T2X_1$, $D7X_1$, $E10X_1$, $M13X_4$, $W24X_1$, $G32X_1$, $K38X_2$, $G45X_2$, $G51X_5$, $A63X_7$, $E66X_5$, $E66X_2$, R75H, C91R, $G93X_6$, $H97X_6$, $H97X_5$, $A107X_5$, $E108X_2$, D109N, P110H, $H124X_6$, $A126X_2$, H129R, H129N, F150P, F150S, $S165X_5$, or any combination thereof relative to SEQ ID NO: 50 when optimally aligned, wherein $X_1$ is A or G; $X_2$ is D or E; $X_3$ is N or Q; $X_4$ is R or K; $X_5$ is I, L, M, or V; $X_6$ is F, Y, or W; and $X_7$ is S or T. In some embodiments, said polypeptide comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity any one of SEQ ID NOs. 836-860, or a variant thereof. In some embodiments, said polypeptide comprises any one of SEQ ID NOs: 839, 841, 843, 844, 847, 848, 849, 850, 851, 852, or 859. In some embodiments, said substitution comprises W24G, G51V, E108D, P110H, F150P, D7G, E10G, or H129N, or any combination thereof, relative to SEQ ID NO: 50 when optimally aligned. In some embodiments, said polypeptide further comprises a nucleic acid binding domain, an endonuclease domain, or a nickase domain. In some embodiments, said polypeptide comprises said endonuclease domain or said nickase domain, wherein said endonuclease domain or said nickase domain comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to any one of SEQ ID NOs: 70-78, 596, 597, Sequence Number: A598, SEQ ID NOs: 1120, or 1122-1127, or a variant thereof. In some embodiments, said polypeptide comprises said nickase domain, wherein said nickase domain comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof.

In some aspects, the present disclosure provides for a system comprising: (a) any of the polypeptides for base editor fusions described herein (e.g. endonuclease deaminase fusions); and (b) an engineered guide polynucleotide configured to form a complex with said endonuclease domain comprising: (i) a guide ribonucleic acid sequence configured to hybridize to a target deoxyribonucleic acid sequence; and (ii) a ribonucleic acid sequence configured to bind to said endonuclease domain. In some embodiments, said engineered guide polynucleotide further comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to non-degenerate nucleotides of any one of SEQ ID NOs: 88-96, 917-931, 963-967, or 1099-1105.

In some aspects, the present disclosure provides for a method of deaminating a cytosine residue in a cell, comprising introducing to said cell: (a) a vector encoding a polypeptide with cytidine deaminase activity; and (b) a vector encoding a FAM72A protein. In some embodiments, said vector encoding said FAM72A protein comprises a sequence having at least 80% identity to SEQ ID NO: 1115, or encodes a sequence having at least 80% identity to SEQ ID NO: 1121. In some embodiments, said polypeptide with cytidine deaminase activity comprises a sequence having at least 80% identity to any one of SEQ ID NOs: 1-49, 444-447, 599-675, 744-835, 970-982, or a variant thereof. In some embodiments, said polypeptide with cytidine deaminase activity further comprises a nucleic acid binding domain, an endonuclease domain, or a nickase domain. In some embodiments, said polypeptide with cytidine deaminase activity comprises said endonuclease domain or said nickase domain, wherein said endonuclease domain or said nickase domain comprises a sequence having at least 80% identity to any one of SEQ ID NOs: 70-78, 596, 597, Sequence Number: A598, SEQ ID NOs: 1120, or 1122-1127, or a variant thereof. In some embodiments, said polypeptide with cytidine deaminase activity comprises said nickase domain, wherein said nickase domain comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597, or any combination thereof.

In some aspects, the present disclosure provides for an engineered nucleic acid editing system, comprising: an endonuclease comprising a RuvC domain and an HNH domain, wherein said endonuclease is derived from an uncultivated microorganism, wherein said endonuclease is a class 2, type II endonuclease, wherein said endonuclease is configured to be deficient in nuclease activity; a base editor coupled to said endonuclease; and an engineered guide ribonucleic acid structure configured to form a complex with said endonuclease comprising: a guide ribonucleic acid sequence configured to hybridize to a target deoxyribonucleic acid sequence; and a ribonucleic acid sequence configured to bind to said endonuclease. In some embodiments, said RuvC domain lacks nuclease activity. In some embodiments, said class 2, type II endonuclease comprises a nickase mutation. In some embodiments, said class 2, type II endonuclease comprises the aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597 when optimally aligned. In some embodiments, said endonuclease comprises an aspartate to alanine mutation at residue 9 relative to SEQ ID NO: 70, residue 13 relative to SEQ ID NO: 72, or residue 17 relative to SEQ ID NO: 75 when optimally aligned. In some embodiments, said endonuclease comprises a sequence with at least 95% sequence identity to any one of SEQ ID NOs:70-78 or 597, or a variant thereof. In some aspects, the present disclosure provides for an engineered nucleic acid editing system comprising: an endonuclease having at least 95% sequence identity to any one of SEQ ID NOs:70-78 or 597, or a variant thereof; a base editor coupled to said endonuclease; and an engineered guide ribonucleic acid structure configured to form a complex with said endonuclease comprising: a guide ribonucleic acid sequence configured to hybridize to a target deoxyribonucleic acid sequence; and a ribonucleic acid sequence configured to bind to said endonuclease. In some aspects, the present disclosure provides for an engineered nucleic acid editing system comprising: an endonuclease configured to bind to a protospacer adjacent motif (PAM) sequence comprising any one of Sequence Numbers: A360-A368 or A598, or a variant thereof, wherein said endonuclease is a class 2, type II endonuclease, and wherein said endonuclease is configured to be deficient in nuclease activity; a base editor coupled to said endonuclease; and an engineered guide ribonucleic acid structure configured to form a complex with said endonuclease comprising: a guide ribonucleic acid sequence configured to hybridize to a target deoxyribonucleic acid sequence; and a ribonucleic acid sequence configured to bind to said endonuclease. In some embodiments, said endonuclease comprises a nickase mutation. In some embodiments, said endonuclease is configured to cleave one strand of a double-stranded target deoxyribonucleic acid. In some embodiments, said class 2, type II endonuclease comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597 when optimally aligned. In some embodiments, said base editor comprises a sequence having at least 70%, 80%, 90% or 95% identity to any one of SEQ ID NOs: 1-51, 57-66, 385-443, 444-475, 594-595, or 599-675, or a variant thereof. In some embodiments, said base editor comprises a sequence having at least 70%, 80%, 90% or 95% identity to any one of SEQ ID NOs: 50-51 or 385-390. In some embodiments, said RuvC domain lacks nuclease activity. In some embodiments, said endonuclease is derived from an uncultivated microorganism. In some embodiments, said endonuclease has less than 80% identity to a Cas9 endonuclease. In some embodiments, said endonuclease further comprises an HNH domain. In some embodiments, said engineered guide ribonucleic acid sequence comprises a sequence with at least 80% sequence identity to non-degenerate nucleotides of any one of SEQ ID NOs: 88-96, 488-489, or 679-680, or a variant thereof. In some aspects, the present disclosure provides for an engineered nucleic acid editing system comprising, an engineered guide ribonucleic acid structure comprising: a guide ribonucleic acid sequence configured to hybridize to a target deoxyribonucleic acid sequence; and a ribonucleic acid sequence configured to bind to an endonuclease, wherein said engineered ribonucleic acid sequence comprises a sequence with at least 80% sequence identity to non-degenerate nucleotides of any one of SEQ ID NOs: 88-96, 488-489, or 679-680, or a variant thereof; a class 2, type II endonuclease configured to bind to said engineered guide ribonucleic acid; and a base editor coupled to said endonuclease. In some embodiments, said base editor comprises a sequence having at least 70%, 80%, 90% or 95% identity to any one of SEQ ID NOs: 50-51 or 385-390. In some embodiments, said endonuclease is configured to bind to a protospacer adjacent motif (PAM) sequence selected from the group consisting of Sequence Numbers: A360-A368 or A598. In some embodiments, said base editor comprises a sequence with at least 70%, 80%, 90% or 95% identity to any one of SEQ ID NOs: 1-51, 57-66, 385-443, 444-475, 594-595, or 599-675, or a variant thereof. In some embodiments, said base editor is an adenine deaminase. In some embodiments, said adenosine deaminase comprises a sequence with at least 70%, 80%, 90% or 95% identity to any one of SEQ ID NOs: 50-51, 57, 385-443, 448-475, or 595, or a variant thereof. In some embodiments, said base editor is a cytidine deaminase. In some embodiments, said cytidine deaminase comprises a sequence with at least 70%, 80%, 90% or 95% identity to any one of SEQ ID NOs: 1-49, 444-447, 594, or 58-66, or a variant thereof. In some embodiments, the system further comprises a uracil DNA glycosylase inhibitor coupled to said endonuclease or said base editor. In some embodiments, said uracil DNA glycosylase inhibitor comprises a sequence with at least 70%, 80%, 90% or 95% identity to any one of SEQ ID NOs: 52-56 or SEQ ID NO: 67. In some embodiments, said engineered guide ribonucleic acid structure comprises at least two ribonucleic acid polynucleotides. In some embodiments, said engineered guide ribonucleic acid structure comprises one ribonucleic acid polynucleotide comprising said guide ribonucleic acid sequence and said tracr ribonucleic acid sequence. In some embodiments, said guide ribonucleic acid sequence is complementary to a prokaryotic, bacterial, archaeal, eukaryotic, fungal, plant, mammalian, or human genomic sequence. In some embodiments, said guide ribonucleic acid sequence is 15-24 nucleotides in length. In some embodiments, said endonuclease comprises one or more nuclear localization sequences (NLSs) proximal to an N- or C-terminus of said endonuclease. In some embodiments, said NLS comprises a sequence with at least 90% identity to a selected from SEQ ID NOs: 369-384, or a variant thereof. In some embodiments, said endonuclease is covalently coupled directly to said base editor or covalently coupled to said base editor through a linker. In some embodiments, said endonuclease comprises an aspartate to alanine mutation at residue 9 relative to SEQ ID NO: 70, residue 13 relative to SEQ ID NOs: 71, 72, or 74, residue 12 relative to SEQ ID NO: 73 or 78, residue 17 relative to SEQ ID NO: 75, residue 23 relative to SEQ ID NO: 76, residue 8 relative to SEQ ID NO: 77, or residue 10 relative to SEQ ID NO: 597 when optimally aligned. In some embodiments, said endonuclease comprises an aspartate to alanine mutation at residue 9 relative to SEQ ID NO: 70, residue 13 relative to SEQ ID NO: 72, or residue 17 relative to SEQ ID NO: 75 when optimally aligned. In some embodiments, a polypeptide comprises said endonuclease and said base editor. In some embodiments, said endonuclease is configured to cleave one strand of a double-stranded target deoxyribonucleic acid. In some embodiments, said system further comprises a source of $Mg^{2+}$. In some embodiments: (a) said endonuclease comprises a sequence at least 70%, at least 80%, or at least 90% identical to any one of SEQ ID NOs: 70, 71, 73, 74, 76, 78, 77, or 78, or a variant thereof; (b) said guide RNA structure comprises a sequence at least 70%, at least 80%, or at least 90% identical to non-degenerate nucleotides of any one of SEQ ID NOs: 88, 89, 91, 92, 94, 96, 95, or 488; (c) said endonuclease is configured to bind to a PAM comprising any one of Sequence Numbers: A360, A361, A363, A365, A367, or A368; or (d) said base editor comprises a sequence at least 70%, at least 80%, or at least 90% identical to SEQ ID NOs: 58 or 595, or a variant thereof. In some embodiments: (a) said endonuclease comprises a sequence at least 70%, at least 80%, or at least 90% identical to any one of SEQ ID NOs: 70, 71, or 78, or a variant thereof; (b) said guide RNA structure comprises a sequence at least 70%, at least 80%, or at least 90% identical to non-degenerate nucleotides of at least one of SEQ ID NOs: 88, 89, or 96; (c) said endonuclease is configured to bind to a PAM comprising any one of Sequence Numbers: A360, A362, or A368; or (d) said base editor comprises a sequence at least 70%, at least 80%, or at least 90% identical to SEQ ID NO: 594, or a variant thereof. In some embodiments, said sequence identity is determined by a BLASTP, CLUSTALW, MUSCLE, MAFFT, or Smith-Waterman homology search algorithm. In some embodiments, said sequence identity is determined by said BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment. In some embodiments, said endonuclease is configured to be catalytically dead. In some embodiments, said endonuclease is configured to cleave one strand of a double-stranded target deoxyribonucleic acid.

In some aspects, the present disclosure provides for a nucleic acid comprising an engineered nucleic acid sequence optimized for expression in an organism, wherein said nucleic acid encodes a class 2, type II endonuclease coupled to a base editor, and wherein said endonuclease is derived from an uncultivated microorganism.

In some aspects, the present disclosure provides for a nucleic acid comprising an engineered nucleic acid sequence optimized for expression in an organism, wherein said nucleic acid encodes an endonuclease having at least 70% sequence identity to any one of SEQ ID NOs: 70-78 coupled to a base editor. In some embodiments, said endonuclease comprises a sequence encoding one or more nuclear localization sequences (NLSs) proximal to an N- or C-terminus of said endonuclease. In some embodiments, said NLS comprises a sequence with at least 90% identity to a selected from SEQ ID NOs: 369-384, or a variant thereof. In some embodiments, said organism is prokaryotic, bacterial, eukaryotic, fungal, plant, mammalian, rodent, or human.

In some aspects, the present disclosure provides for a vector comprising a nucleic acid sequence encoding a class 2, type II endonuclease coupled to a base editor, wherein said endonuclease is derived from an uncultivated microorganism.

In some aspects, the present disclosure provides for a vector comprising the nucleic acid of any of the aspects or embodiments described herein. In some embodiments, the vector further comprises a nucleic acid encoding an engineered guide ribonucleic acid structure configured to form a complex with said endonuclease comprising: a guide ribonucleic acid sequence configured to hybridize to a target deoxyribonucleic acid sequence; and a ribonucleic acid sequence configured to binding to said endonuclease. In some embodiments, the vector is a plasmid, a minicircle, a CELiD, an adeno-associated virus (AAV) derived virion, or a lentivirus.

In some aspects, the present disclosure provides for a cell comprising the vector of any of the aspects or embodiments described herein.

In some aspects, the present disclosure provides for a method of manufacturing an endonuclease, comprising cultivating the cell of any of the aspects or embodiments described herein.

In some aspects, the present disclosure provides for a method for modifying a double-stranded deoxyribonucleic acid polynucleotide comprising contacting said double-stranded deoxyribonucleic acid polynucleotide with a complex comprising: an endonuclease comprising a RuvC domain and an HNH domain, wherein said endonuclease is derived from an uncultivated microorganism, wherein said endonuclease is a class 2, type II endonuclease, and wherein the endonuclease is configured to be deficient in nuclease activity; a base editor coupled to said endonuclease; and an engineered guide ribonucleic acid structure configured to bind to said endonuclease and said double-stranded deoxyribonucleic acid polynucleotide; wherein said double-stranded deoxyribonucleic acid polynucleotide comprises a protospacer adjacent motif (PAM). In some embodiments, said endonuclease comprising a RuvC domain and an HNH domain is covalently coupled directly to said base editor or covalently coupled to said base editor through a linker. In some embodiments, said endonuclease comprising a RuvC domain and an HNH domain comprises a sequence with at least 95% sequence identity to any one of SEQ ID NOs:70-78 or 597, or a variant thereof.

In some aspects, the present disclosure provides for a method for modifying a double-stranded deoxyribonucleic acid polynucleotide, comprising contacting said double-stranded deoxyribonucleic acid polynucleotide with a complex comprising: a class 2, type II endonuclease, a base editor coupled to said endonuclease, and an engineered guide ribonucleic acid structure configured to bind to said endonuclease and said double-stranded deoxyribonucleic acid polynucleotide; wherein said double-stranded deoxyribonucleic acid polynucleotide comprises a protospacer adjacent motif (PAM); and wherein said PAM comprises a sequence selected from the group consisting of SEQ ID NOs: 70-78 or 597. In some embodiments, said class 2, type II endonuclease is covalently coupled to said base editor or coupled to said base editor through a linker. In some embodiments, said base editor comprises a sequence with at least 70%, at least 80%, at least 90% or at least 95% identity to a sequence selected from SEQ ID NOs: 1-51, 57-66, 385-443, 444-475, 594-595, or 599-675, or a variant thereof. In some embodiments, said base editor comprises an adenine deaminase; said double-stranded deoxyribonucleic acid polynucleotide comprises an adenine; and modifying said double-stranded deoxyribonucleic acid polypeptide comprises converting said adenine to guanine. In some embodiments, said adenine deaminase comprises a sequence with at least 70%, 80%, 90% or 95% sequence identity to any one of SEQ ID NOs: 50-51, 57, 385-443, 448-475, or 595, or a variant thereof. In some embodiments, said base editor comprises a cytidine deaminase; said double-stranded deoxyribonucleic acid polynucleotide comprises a cytosine; and modifying said double-stranded deoxyribonucleic acid polypeptide comprises converting said cytosine to uracil. In some embodiments, said cytidine deaminase comprises a sequence with at least 70%, 80%, 90% or 95% sequence identity to any one of SEQ ID NOs: 1-49, 444-447, 594, or 58-66, or a variant thereof. In some embodiments, said complex further comprises a uracil DNA glycosylase inhibitor coupled to said endonuclease or said base editor. In some embodiments, said uracil DNA glycosylase inhibitor comprises a sequence with at least 70%, 80%, 90% or 95% identity to any one of SEQ ID NOs: 52-56 or SEQ ID NO: 67, or a variant thereof. In some embodiments, said double-stranded deoxyribonucleic acid polynucleotide comprises a first strand comprising a sequence complementary to a sequence of said engineered guide ribonucleic acid structure and a second strand comprising said PAM. In some embodiments, said PAM is directly adjacent to the 3' end of said sequence complementary to said sequence of said engineered guide ribonucleic acid structure. In some embodiments, said class 2, type II endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, said class 2, type II endonuclease is derived from an uncultivated microorganism. In some embodiments, said double-stranded deoxyribonucleic acid polynucleotide is a eukaryotic, plant, fungal, mammalian, rodent, or human double-stranded deoxyribonucleic acid polynucleotide.

In some aspects, the present disclosure provides for a method of modifying a target nucleic acid locus, said method comprising delivering to said target nucleic acid locus said engineered nucleic acid editing system of any of the aspects or embodiments described herein, wherein said endonuclease is configured to form a complex with said engineered guide ribonucleic acid structure, and wherein said complex is configured such that upon binding of said complex to said target nucleic acid locus, said complex modifies a nucleotide of said target nucleic locus. In some embodiments, said engineered nucleic acid editing system comprises an adenine deaminase, said nucleotide is an adenine, and modifying said target nucleic acid locus comprises converting said adenine to a guanine. In some embodiments, said engineered nucleic acid editing system comprises a cytidine deaminase and a uracil DNA glycosylase inhibitor, said nucleotide is a cytosine and modifying said target nucleic acid locus comprises converting said adenine to a uracil. In some embodiments, said target nucleic acid locus comprises genomic DNA, viral DNA, or bacterial DNA. In some embodiments, said target nucleic acid locus is in vitro. In some embodiments, said target nucleic acid locus is within a cell. In some embodiments, said cell is a prokaryotic cell, a bacterial cell, a eukaryotic cell, a fungal cell, a plant cell, an animal cell, a mammalian cell, a rodent cell, a primate cell, or a human cell. In some embodiments, said cell is within an animal. In some embodiments, said cell is within a cochlea. In some embodiments, said cell is within an embryo. In some embodiments, said embryo is a two-cell embryo. In some embodiments, said embryo is a mouse embryo. In some embodiments, delivering said engineered nucleic acid editing system to said target nucleic acid locus comprises delivering the nucleic acid of any of the aspects or embodiments described herein or the vector of any of the aspects or embodiments described herein. In some embodiments, delivering said engineered nucleic acid editing system to said target nucleic acid locus comprises delivering a nucleic acid comprising an open reading frame encoding said endonuclease. In some embodiments, said nucleic acid comprises a promoter to which said open reading frame encoding said endonuclease is operably linked. In some embodiments, delivering said engineered nucleic acid editing system to said target nucleic acid locus comprises delivering a capped mRNA containing said open reading frame encoding said endonuclease. In some embodiments, delivering said engineered nucleic acid editing system to said target nucleic acid locus comprises delivering a translated polypeptide. In some embodiments, delivering said engineered nucleic acid editing system to said target nucleic acid locus comprises delivering a deoxyribonucleic acid (DNA) encoding said engineered guide ribonucleic acid structure operably linked to a ribonucleic acid (RNA) pol III promoter.

In some aspects, the present disclosure provides for an engineered nucleic acid editing polypeptide, comprising: an endonuclease comprising a RuvC domain and an HNH domain, wherein said endonuclease is derived from an uncultivated microorganism, wherein said endonuclease is a class 2, type II endonuclease, and wherein the endonuclease is configured to be deficient in nuclease activity; and a base editor coupled to said endonuclease. In some embodiments, said endonuclease comprises a sequence with at least 95% sequence identity to any one of SEQ ID NOs:70-78 or 597, or a variant thereof.

In some aspects, the present disclosure provides for an engineered nucleic acid editing polypeptide, comprising: an endonuclease having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597, or a variant thereof, wherein the endonuclease is configured to be deficient in nuclease activity; and a base editor coupled to said endonuclease. In some aspects, the present disclosure provides for an engineered nucleic acid editing polypeptide, comprising: an endonuclease configured to bind to a protospacer adjacent motif (PAM) sequence comprising any one of Sequence Numbers: A360-A368 or A598, wherein said endonuclease is a class 2, type II endonuclease, and wherein the endonuclease is configured to be deficient in nuclease activity; and a base editor coupled to said endonuclease. In some embodiments, said endonuclease is derived from an uncultivated microorganism. In some embodiments, said endonuclease has less than 80% identity to a Cas9 endonuclease. In some embodiments, said endonuclease further comprises an HNH domain. In some embodiments, said tracr ribonucleic acid sequence comprises a sequence with at least 80% sequence identity to about 60 to 90 consecutive nucleotides selected from any one of SEQ ID NOs: 88-96, 488, 489, and 679-680. In some embodiments, said base editor comprises a sequence with at least 70%, 80%, 90% or 95% identity to any one of SEQ ID NOs: 1-51, 57-66, 385-443, 444-475, 594-595, or 599-675, or a variant thereof. In some embodiments, said base editor is an adenine deaminase. In some embodiments, said adenosine deaminase comprises a sequence with at least 70%, 80%, 90% or 95% sequence identity to any one of SEQ ID NOs: 50-51, 57, 385-443, 448-475, or 595, or a variant thereof. In some embodiments, said base editor is a cytidine deaminase. In some embodiments, said cytidine deaminase comprises a sequence with at least 70%, 80%, 90% or 95% sequence identity to any one of SEQ ID NOs: 1-49, 444-447, 594, or 58-66, or a variant thereof.

In some aspects, the present disclosure provides for an engineered nucleic acid editing polypeptide, comprising: an endonuclease, wherein said endonuclease is configured to be deficient in endonuclease activity; and a base editor coupled to said endonuclease, wherein said base editor comprises a sequence with at least 70%, 80%, 90% or 95% sequence identity to any one of SEQ ID NOs: 1-51, 385-386, 387-443, 444-447, 488-475, or 595, or a variant thereof. In some embodiments, said endonuclease is configured to cleave one strand of a double-stranded target deoxyribonucleic acid. In some embodiments, said endonuclease is configured to be catalytically dead. In some embodiments, said endonuclease is a Class II, type II endonuclease or a Class II, type V endonuclease. In some embodiments, said endonuclease comprises a sequence having at least 70%, 80%, 90% or 95% sequence identity to any one of SEQ ID NOs:70-78 or 597, or a variant thereof. In some embodiments, said endonuclease comprises a nickase mutation. In some embodiments, said endonuclease comprises the aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597 when optimally aligned. In some embodiments, said endonuclease is configured to bind to a protospacer adjacent motif (PAM) sequence selected from the group consisting of Sequence Numbers: A360-A368 or A598. In some embodiments, said base editor is an adenine deaminase. In some embodiments, said adenosine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 50-51, 385-443, or 448-475, or a variant thereof. In some embodiments, said adenosine deaminase comprises a sequence with at least 70%, 80%, 90% or 95% identity to any one of SEQ ID NOs: 50-51, 385-390, or 595, or a variant thereof. In some embodiments, said base editor is a cytidine deaminase. In some embodiments, said cytidine deaminase comprises a sequence with at least 70%, 80%, 90% or 95% identity to any one of SEQ ID NOs: 1-49, 444-447, or a variant thereof. In some embodiments, the polypeptide further comprises a uracil DNA glycosylase inhibitor coupled to said endonuclease or said base editor. In some embodiments, said uracil DNA glycosylase inhibitor comprises a sequence with at least 70%, 80%, 90% or 95% identity to any one of SEQ ID NOs: 52-56 or SEQ ID NO: 67, or a variant thereof. In some embodiments, said endonuclease comprises one or more nuclear localization sequences (NLSs) proximal to an N- or C-terminus of said endonuclease. In some embodiments, said NLS comprises a sequence with at least 90% identity to a selected from SEQ ID NOs: 369-384, or a variant thereof. In some embodiments, said endonuclease is covalently coupled directly to said base editor or covalently coupled to said base editor through a linker.

In some aspects, the present disclosure provides for a nucleic acid comprising an engineered nucleic acid sequence optimized for expression in an organism, wherein said nucleic acid encodes a sequence having at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 1-51, 385-386, 387-443, 444-447, or 488-475, or a variant thereof. In some embodiments, said organism is prokaryotic, bacterial, eukaryotic, fungal, plant, mammalian, rodent, or human.

In some aspects, the present disclosure provides for a vector comprising the nucleic acid of any of the aspects or embodiments described herein. In some embodiments, the vector is a plasmid, a minicircle, a CELiD, an adeno-associated virus (AAV) derived virion, or a lentivirus.

In some aspects, the present disclosure provides for a cell comprising the vector of any one of the aspects or embodiments described herein.

In some aspects, the present disclosure provides for a method of manufacturing a base editor, comprising cultivating said cell of any one of the aspects or embodiments described herein.

In some aspects, the present disclosure provides for a system comprising: (a) the nucleic acid editing polypeptide of any of the aspects or embodiments described herein; and (b) an engineered guide ribonucleic acid structure configured to form a complex with said nucleic acid editing polypeptide comprising: a guide ribonucleic acid sequence configured to hybridize to a target deoxyribonucleic acid sequence; and a ribonucleic acid sequence configured to bind to said endonuclease. In some embodiments, said engineered guide ribonucleic acid sequence comprises a sequence with at least 80% sequence identity to non-degenerate nucleotides of any one of SEQ ID NOs: 88-96, 488-489, or 679-680.

In some aspects, the present disclosure provides for a method of modifying a target nucleic acid locus, said method comprising delivering to said target nucleic acid locus said engineered nucleic acid editing polypeptide of any of the aspects or embodiments described herein or said system of any of the aspects or embodiments described herein, wherein said complex is configured such that upon binding of said complex to said target nucleic acid locus, said complex modifies a nucleotide of said target nucleic locus.

In some aspects, the present disclosure provides for an engineered nucleic acid editing system, comprising: (a) an endonuclease comprising a RuvC domain and an HNH domain, wherein the endonuclease is derived from an uncultivated microorganism, wherein the endonuclease is a class 2, type II endonuclease, and wherein the RuvC domain lacks nuclease activity; (b) a base editor coupled to the endonuclease; and (c) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease. In some embodiments, the endonuclease comprises a sequence with at least 95% sequence identity to any one of SEQ ID NOs: 70-78.

In some aspects, the present disclosure provides for an engineered nucleic acid editing system comprising: (a) an endonuclease having at least 95% sequence identity to any one of SEQ ID NOs: 70-78, wherein the endonuclease comprises a RuvC domain lacking nuclease activity; a base editor coupled to the endonuclease; and an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease.

In some aspects, the present disclosure provides for an engineered nucleic acid editing system comprising: (a) an endonuclease configured to bind to a protospacer adjacent motif (PAM) sequence comprising Sequence Numbers: A360-A368, wherein the endonuclease is a class 2, type II endonuclease, and wherein the endonuclease comprises a RuvC domain lacking nuclease activity; and (b) a base editor coupled to the endonuclease; and (c) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease.

In some embodiments, the endonuclease is derived from an uncultivated microorganism. In some embodiments, the endonuclease has less than 80% identity to a Cas9 endonuclease. In some embodiments, the endonuclease further comprises an HNH domain. In some embodiments, the tracr ribonucleic acid sequence comprises a sequence with at least 80% sequence identity to about 60 to 90 consecutive nucleotides selected from any one of SEQ ID NOs: 88-96, 488, 489, and 679-680.

In some aspects, the present disclosure provides an engineered nucleic acid editing system comprising, (a) an engineered guide ribonucleic acid structure comprising: (i) a guide ribonucleic acid sequence configured to hybridize to a target deoxyribonucleic acid sequence; and (ii) a tracr ribonucleic acid sequence configured to bind to an endonuclease, wherein the tracr ribonucleic acid sequence comprises a sequence with at least 80% sequence identity to about 60 to 90 consecutive nucleotides selected from any one of SEQ ID NOs: 88-96, 488, 489, and 679-680; and a class 2, type II endonuclease configured to bind to the engineered guide ribonucleic acid.

In some embodiments, the endonuclease is configured to bind to a protospacer adjacent motif (PAM) sequence selected from the group consisting of Sequence Numbers: A360-A368. In some embodiments, the base editor comprises a sequence with at least 70%, 80%, 90% or 95% identity to any one of SEQ ID NOs: 1-51 and 385-475. In some embodiments, the base editor is an adenine deaminase. In some embodiments, the adenosine deaminase comprises a sequence with at least 95% identity to SEQ ID NO: 57. In some embodiments, the base editor is a cytidine deaminase. In some embodiments, the cytidine deaminase comprises a sequence with at least 95% identity to SEQ ID NO: 58. In some embodiments, the cytidine deaminase comprises a sequence with at least 95% identity to any one of SEQ ID NOs: 59-66.

In some embodiments, the engineered nucleic acid editing system further comprises a uracil DNA glycosylase inhibitor. In some embodiments, the uracil DNA glycosylase inhibitor comprises a sequence with at least 70%, 80%, 90% or 95% identity to any one of SEQ ID NOs: 52-56 or SEQ ID NO: 67.

In some embodiments, the engineered guide ribonucleic acid structure comprises at least two ribonucleic acid polynucleotides. In some embodiments, the engineered guide ribonucleic acid structure comprises one ribonucleic acid polynucleotide comprising the guide ribonucleic acid sequence and the tracr ribonucleic acid sequence. In some embodiments, the guide ribonucleic acid sequence is complementary to a prokaryotic, bacterial, archaeal, eukaryotic, fungal, plant, mammalian, or human genomic sequence. In some embodiments, the guide ribonucleic acid sequence is 15-24 nucleotides in length. In some embodiments, the endonuclease comprises one or more nuclear localization sequences (NLSs) proximal to an N- or C-terminus of said endonuclease. In some embodiments, the endonuclease is covalently coupled directly to the base editor or covalently coupled to the base editor through a linker. In some embodiments, a polypeptide comprises the endonuclease and the base editor. In some embodiments, the endonuclease is configured to cleave one strand of a double-stranded target deoxyribonucleic acid. In some embodiments, the endonuclease comprises SEQ ID NO: 370. In some embodiments, the system further comprises a source of $Mg^{2+}$.

In some embodiments, the endonuclease comprises a sequence at least 70%, at least 80%, or at least 90% identical to SEQ ID NO: 70; the guide RNA structure comprises a sequence at least 70%, at least 80%, or at least 90% identical to SEQ ID NO: 88; and the endonuclease is configured to bind to a PAM comprising Sequence Number: A360.

In some embodiments, the endonuclease comprises a sequence at least 70%, at least 80%, or at least 90% identical to SEQ ID NO: 71; the guide RNA structure comprises a sequence at least 70%, at least 80%, or at least 90% identical to SEQ ID NO: 89; and the endonuclease is configured to bind to a PAM comprising Sequence Number: A361.

In some embodiments, the endonuclease comprises a sequence at least 70%, at least 80%, or at least 90% identical to SEQ ID NO: 73; the guide RNA structure comprises a sequence at least 70%, at least 80%, or at least 90% identical to SEQ ID NO: 91; and the endonuclease is configured to bind to a PAM comprising Sequence Number: A363.

In some embodiments, the endonuclease comprises a sequence at least 70%, at least 80%, or at least 90% identical to SEQ ID NO: 75; the guide RNA structure comprises a sequence at least 70%, at least 80%, or at least 90% identical to SEQ ID NO: 93; and the endonuclease is configured to bind to a PAM comprising Sequence Number: A365.

In some embodiments, the endonuclease comprises a sequence at least 70%, at least 80%, or at least 90% identical to SEQ ID NO: 76; the guide RNA structure comprises a sequence at least 70%, at least 80%, or at least 90% identical to SEQ ID NO: 94; and the endonuclease is configured to bind to a PAM comprising Sequence Number: A366.

In some embodiments, the endonuclease comprises a sequence at least 70%, at least 80%, or at least 90% identical to SEQ ID NO: 77; the guide RNA structure comprises a sequence at least 70%, at least 80%, or at least 90% identical to SEQ ID NO: 95; and the endonuclease is configured to bind to a PAM comprising Sequence Number: A367.

In some embodiments, the endonuclease comprises a sequence at least 70%, at least 80%, or at least 90% identical to SEQ ID NO: 78; the guide RNA structure comprises a sequence at least 70%, at least 80%, or at least 90% identical to SEQ ID NO: 96; and the endonuclease is configured to bind to a PAM comprising Sequence Number: A368.

In some embodiments, the base editor comprises an adenine deaminase. In some embodiments, the adenine deaminase comprises SEQ ID NO: 57. In some embodiments, the base editor comprises a cytidine deaminase. In some embodiments, the cytidine deaminase comprises SEQ ID NO: 58. In some embodiments, the engineered nucleic acid editing system described herein further comprises a uracil DNA glycosylation inhibitor. In some embodiments, the uracil DNA glycosylation inhibitor comprises SEQ ID NO: 67.

In some embodiments, the sequence identity is determined by a BLASTP, CLUSTALW, MUSCLE, MAFFT, or Smith-Waterman homology search algorithm. In some embodiments, the sequence identity is determined by said BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment.

In some aspects, the present disclosure provides a nucleic acid comprising an engineered nucleic acid sequence optimized for expression in an organism, wherein the nucleic acid encodes a class 2, type II endonuclease coupled to a base editor, and wherein the endonuclease is derived from an uncultivated microorganism.

In some aspects, the present disclosure provides a nucleic acid comprising an engineered nucleic acid sequence optimized for expression in an organism, wherein the nucleic acid encodes an endonuclease having at least 70% sequence identity to any one of SEQ ID NOs: 70-78 coupled to a base editor. In some embodiments, the endonuclease comprises a sequence encoding one or more nuclear localization sequences (NLSs) proximal to an N- or C-terminus of said endonuclease. In some embodiments, the organism is prokaryotic, bacterial, eukaryotic, fungal, plant, mammalian, rodent, or human.

In some aspects, the present disclosure provides a vector comprising a nucleic acid sequence encoding a class 2, type II endonuclease coupled to a base editor, wherein said endonuclease is derived from an uncultivated microorganism. In some embodiments, the vector comprises the nucleic acid described herein. In some embodiments, the vector further comprises a nucleic acid encoding an engineered guide ribonucleic acid structure configured to form a complex with the endonuclease comprising: a guide ribonucleic acid sequence configured to hybridize to a target deoxyribonucleic acid sequence; and a tracr ribonucleic acid sequence configured to binding to the endonuclease. In some embodiments, the vector is a plasmid, a minicircle, a CELiD, an adeno-associated virus (AAV) derived virion, or a lentivirus. In some aspects, the present disclosure provides a cell comprising the vector described herein. In some aspects, the present disclosure provides a method of manufacturing an endonuclease, comprising cultivating the cell described herein.

In some aspects, the present disclosure provides a method for modifying a double-stranded deoxyribonucleic acid polynucleotide comprising contacting the double-stranded deoxyribonucleic acid polynucleotide with a complex comprising: an endonuclease comprising a RuvC domain and an HNH domain, wherein the endonuclease is derived from an uncultivated microorganism, wherein the endonuclease is a class 2, type II endonuclease, and wherein the RuvC domain lacks nuclease activity; a base editor coupled to the endonuclease; and an engineered guide ribonucleic acid structure configured to bind to the endonuclease and the double-stranded deoxyribonucleic acid polynucleotide; wherein the double-stranded deoxyribonucleic acid polynucleotide comprises a protospacer adjacent motif (PAM).

In some embodiments, the endonuclease comprising a RuvC domain and an HNH domain is covalently coupled directly to the base editor or covalently coupled to the base editor through a linker. In some embodiments, the endonuclease comprising a RuvC domain and an HNH domain comprises a sequence with at least 95% sequence identity to any one of SEQ ID NOs: 70-78.

In some aspects, the present disclosure provides a method for modifying a double-stranded deoxyribonucleic acid polynucleotide, comprising contacting the double-stranded deoxyribonucleic acid polynucleotide with a complex comprising: a class 2, type II endonuclease, a base editor coupled to the endonuclease, and an engineered guide ribonucleic acid structure configured to bind to the endonuclease and the double-stranded deoxyribonucleic acid polynucleotide; wherein the double-stranded deoxyribonucleic acid polynucleotide comprises a protospacer adjacent motif (PAM); and wherein the PAM comprises a sequence selected from the group consisting of Sequence Numbers: A360-A368.

In some embodiments, the class 2, type II endonuclease is covalently coupled to the base editor or coupled to the base editor through a linker. In some embodiments, the base editor comprises a sequence with at least 70%, at least 80%, at least 90% or at least 95% identity to a sequence selected from SEQ ID NOs: 1-51 and 385-475. In some embodiments, the base editor comprises an adenine deaminase; the double-stranded deoxyribonucleic acid polynucleotide comprises an adenine; and modifying the double-stranded deoxyribonucleic acid polypeptide comprises converting the adenine to guanine. In some embodiments, the adenine deaminase comprises a sequence with at least 95% identity to SEQ ID NO: 57.

In some embodiments, the base editor comprises a cytidine deaminase; the double-stranded deoxyribonucleic acid polynucleotide comprises a cytosine; and modifying the double-stranded deoxyribonucleic acid polypeptide comprises converting the cytosine to uracil. In some embodiments, the cytidine deaminase comprises a sequence with at least 95% identity to SEQ ID NO: 58. In some embodiments, the cytidine deaminase comprises a sequence with at least 95% identity to any one of SEQ ID NOs: 59-66.

In some embodiments, the complex further comprises a uracil DNA glycosylase inhibitor. In some embodiments, the uracil DNA glycosylase inhibitor comprises a sequence with at least 70%, 80%, 90% or 95% identity to any one of SEQ ID NOs: 52-56 or SEQ ID NO: 67. In some embodiments, the double-stranded deoxyribonucleic acid polynucleotide comprises a first strand comprising a sequence complementary to a sequence of the engineered guide ribonucleic acid structure and a second strand comprising said PAM. In some embodiments, the PAM is directly adjacent to the 3' end of the sequence complementary to the sequence of the engineered guide ribonucleic acid structure.

In some embodiments, the class 2, type II endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, the class 2, type II endonuclease is derived from an uncultivated microorganism. In some embodiments, the double-stranded deoxyribonucleic acid polynucleotide is a eukaryotic, plant, fungal, mammalian, rodent, or human double-stranded deoxyribonucleic acid polynucleotide.

In some aspects, the present disclosure provides a method of modifying a target nucleic acid locus, said method comprising delivering to said target nucleic acid locus the engineered nucleic acid editing system described herein, wherein the endonuclease is configured to form a complex with the engineered guide ribonucleic acid structure, and wherein the complex is configured such that upon binding of the complex to the target nucleic acid locus, the complex modifies a nucleotide of the target nucleic locus.

In some embodiments, the engineered nucleic acid editing system comprises an adenine deaminase, the nucleotide is an adenine, and modifying the target nucleic acid locus comprises converting the adenine to a guanine. In some embodiments, the engineered nucleic acid editing system comprises a cytidine deaminase and a uracil DNA glycosylase inhibitor, the nucleotide is a cytosine and modifying the target nucleic acid locus comprises converting the adenine to a uracil. In some embodiments, the target nucleic acid locus comprises genomic DNA, viral DNA, or bacterial DNA. In some embodiments, the target nucleic acid locus is in vitro. In some embodiments, the target nucleic acid locus is within a cell. In some embodiments, the cell is a prokaryotic cell, a bacterial cell, a eukaryotic cell, a fungal cell, a plant cell, an animal cell, a mammalian cell, a rodent cell, a primate cell, or a human cell. In some embodiments, the cell is within an animal.

In some embodiments, the cell is within a cochlea. In some embodiments, the cell is within an embryo. In some embodiments, the embryo is a two-cell embryo. In some embodiments, the embryo is a mouse embryo. In some embodiments, delivering the engineered nucleic acid editing system to the target nucleic acid locus comprises delivering the nucleic acid described herein or the vector described herein. In some embodiments, delivering the engineered nucleic acid editing system to the target nucleic acid locus comprises delivering a nucleic acid comprising an open reading frame encoding the endonuclease.

In some embodiments, the nucleic acid comprises a promoter to which the open reading frame encoding the endonuclease is operably linked. In some embodiments, delivering the engineered nucleic acid editing system to said target nucleic acid locus comprises delivering a capped mRNA containing the open reading frame encoding the endonuclease. In some embodiments, delivering the engineered nucleic acid editing system to the target nucleic acid locus comprises delivering a translated polypeptide. In some embodiments, delivering the engineered nucleic acid editing system to the target nucleic acid locus comprises delivering a deoxyribonucleic acid (DNA) encoding the engineered guide ribonucleic acid structure operably linked to a ribonucleic acid (RNA) pol III promoter.

In some aspects, the present disclosure provides an engineered nucleic acid editing polypeptide, comprising: an endonuclease comprising a RuvC domain and an HNH domain, wherein the endonuclease is derived from an uncultivated microorganism, wherein the endonuclease is a class 2, type II endonuclease, and wherein the RuvC domain lacks nuclease activity; and a base editor coupled to the endonuclease. In some embodiments, the endonuclease comprises a sequence with at least 95% sequence identity to any one of SEQ ID NOs: 70-78.

In some aspects, the present disclosure provides an engineered nucleic acid editing polypeptide, comprising: an endonuclease having at least 95% sequence identity to any one of SEQ ID NOs: 70-78, wherein the endonuclease comprises a RuvC domain lacking nuclease activity; and a base editor coupled to the endonuclease.

In some aspects, the present disclosure provides an engineered nucleic acid editing polypeptide, comprising: an endonuclease configured to bind to a protospacer adjacent motif (PAM) sequence comprising Sequence Numbers: A360-A368, wherein the endonuclease is a class 2, type II endonuclease, and wherein the endonuclease comprises a RuvC domain lacks nuclease activity; and a base editor coupled to the endonuclease.

In some embodiments, the endonuclease is derived from an uncultivated microorganism. In some embodiments, the endonuclease has less than 80% identity to a Cas9 endonuclease. In some embodiments, the endonuclease further comprises an HNH domain. In some embodiments, the tracr ribonucleic acid sequence comprises a sequence with at least 80% sequence identity to about 60 to 90 consecutive nucleotides selected from any one of SEQ ID NOs: 88-96, 488, 489, and 679-680. In some embodiments, the base editor comprises a sequence with at least 70%, 80%, 90% or 95% identity to any one of SEQ ID NOs: 1-51 and 385-475. In some embodiments, the base editor is an adenine deaminase. In some embodiments, the adenosine deaminase comprises a sequence with at least 95% identity to SEQ ID NO: 57. In some embodiments, the base editor is a cytidine deaminase. In some embodiments, the cytidine deaminase comprises a sequence with at least 95% identity to SEQ ID NO: 58. In some embodiments, the adenosine cytidine deaminase comprises a sequence with at least 95% identity to any one of SEQ ID NOs: 59-66.

Additional aspects and advantages of the present disclosure will become readily apparent to those skilled in this art from the following detailed description, wherein only illustrative embodiments of the present disclosure are shown and described. As will be realized, the present disclosure is capable of other and different embodiments, and its several details are capable of modifications in various obvious respects, all without departing from the disclosure. Accordingly, the drawings and description are to be regarded as illustrative in nature, and not as restrictive.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings (also "Figure" and "FIG." herein), of which:

FIG. 12A depicts a graph showing base-editing activity of MGC15-1 and variants, which comprise an N-terminal APOBEC1, the MG15-1 nickase, and a C-terminal UGI. Three MG UGIs were tested for improvements of cytosine base editing activities in *E. coli*. Panel

FIG. 14A shows a map of one plasmid system used for TadA selection. The vector comprises CAT (H193Y), a sgRNA expression cassette targeting CAT, and an ABE expression cassette. In this figure, N-terminal TadA from *E. coli* and a C-terminal SpCas9 (D10A) from *Streptococcus pyogenes* are shown.

FIG. 15A shows photographs of growth plates where different concentrations of chloramphenicol were used to select for antibiotics resistance of *E. coli*. In this example, wild type and two variants of TadA from *E. coli* (EcTadA) were tested. FIG. 15B shows a results summary table demonstrating that ABEs carrying mutated TadA show higher editing efficiencies than the wild type. In these experiments, colonies were picked from the plates with greater than or equal to 0.5 μg/mL Cm. For simplicity, identities of deaminases are shown in the table.

FIG. 16B summarizes the editing efficiencies of MG TadA candidates and demonstrates that MG68-3, and MG68-4 drove base edits of adenine.

FIG. 17A shows photographs of growth plates where wild type MG68-4 and its variant were tested against 0 to 4 μg/mL of chloramphenicol. For simplicity, identities of deaminases are shown. Adenine base editors in this experiment are comprise N-terminal TadA variants and C-terminal SpCas9 (D10A) nickase. Panel (b) shows a summary table depicting editing efficiencies of MG TadA candidates. FIG. 17B demonstrates that MG68-4 and MG68-4 (D109N) showed base edits of adenine, with the D109N mutant showing increased activity. In this experiment, colonies were picked from the plates with greater than or equal to 0.5 μg/mL Cm.

FIG. 18A shows photographs of growth plates of an experiment where an ABE comprising N-terminal MG68-4 (D109N) and C-terminal SpCas9 (D10A) nickase was tested against 0 to 2 μg/mL of chloramphenicol. FIG. 18B shows a summary table depicting editing efficiencies with and without sgRNA. In this experiment, colonies were picked from the plates with greater than or equal to 1 μg/mL Cm.

FIG. 19 shows 28 MG68-4 variants designed for improvements of MG68-4-nMG34-1 base editing activity (SEQ ID NOs: 448-475). 12 residues were selected for targeted mutagenesis to improve editing of the enzymes.

FIG. 22A shows ABE-MG34-1 base editor vs. a reference ABE-SpCas9 (both with TadA*(8.8m) deaminase). FIG. 22E, bottom panel: transformed *E. coli* was grown on plates containing chloramphenicol concentrations of 0, 2, 3, 4, and 8 μg/mL. Plates also contain 100 μg/mL Carbecillin and 0.1 mM IPTG. Colonies grown on plates containing chloramphenicol concentrations of 0, 2, 3, and 4 μg/mL were sequenced to assess reversion of the CAT gene. Experiments were performed in duplicate.

FIG. 23B depicts Percentage of deamination activity of all the active cytidine deaminases on ssDNA. The taxonomic classification of the cytidine deaminases are shown.

FIG. 26A shows relative activity of various CDAs, controls used were a highly active CBE from literature A0A2K5RDN7, as well as rAPOBEC1. FIG. 26B shows quantification of activity of various CDAs in comparison to the highly active CDA A0A2K5RDN7. FIG. 26C (SEQ ID NOs: 1817, 1878, 1817 and 1879) shows MG139-52 activity highlighting the G-A conversion suggesting editing of the opposite strand—the strand in the DNA/RNA heteroduplex in the R-loop.

FIGS. 27A and 27B depict a toxicity assay in mammalian cells. Toxicity of CDAs was measured by stable expression of CDAs as CBEs (fused to MG3-6). HEK293T cells stably expressing CBEs were grown in puromycin for 3 days, alive cells were stained with crystal violet. Crystal violet dye was then solubilized with 1% SDS and quantified in a plate reader. FIG. 27A shows a picture of cells stained with crystal violet; FIG. 27B shows quantification of FIG. 27A. Absorbance was taken in a plate reader at 570 nm.

FIG. 28 depicts mutations identified from chloramphenicol selection in *E. coli*. r1v1 variant was the starting variant for the evolution experiment. 24 variants were identified and the associated mutations were shown in the table.

FIG. 29 depicts beneficial mutations identified from variant screening in HEK293T. The predicted structure of MG68-4 is aligned with $tRNA^{Arg2}$ from *S. aureus* TadA (PDB 2B3J). Key mutated residues are highlighted in the structural display.

FIG. 30 (SEQ ID NOs: 1791, 1792, 687 and 864) depicts screening of MG68-4 variants in HEK293T cells. Four guides were used to screen the activity, editing window, and sequence preference of engineered variants.

FIG. 31 (SEQ ID NOs: 1821-1822, 1819-1820, 1880, 1820, 1880, 1821) depicts the ABE-MG35-1 *E. coli* survival assay sequencing results. Surviving colonies were picked from plates under chloramphenicol selection for the first experimental replicate and Sanger-sequenced. Sequencing of four of five selected colonies show a mutation from A back to G on the negative strand, restoring CAT function from Y193 back to H on the positive strand (boxed nucleotides). A bystander base edit was observed in two of the five sequenced colonies.

FIG. 32 depicts increased cytosine base editing efficiency upon Fam72a expression.

FIG. 33 (SEQ ID NO: 1823) depicts data demonstrating that structurally optimized adenine base editors (ABEs) show varying editing levels in HEK293 cells. Each of 33 ABEs was constructed by inserting the MG68-4 (D109N) deaminase upstream, downstream, or within the MG3-6_3-8 (D13A) nickase enzyme and cloned into the pCMV vector. These plasmids were co-transfected with a plasmid containing one of 8 sgRNAs targeting the HEK293 genome. Data shown is from a sgRNA targeting the ACAGACAAAACTGTGCTAGACA (SEQ ID NO: 1823) sequence. Editing levels (A to G (%)) of A5, A7, A8, A9, and A10 within the spacer sequence are indicated as well as cell viability of each individual experiment (n=2).

FIG. 34A-FIG. 34B depicts rational design of MG68-4 variants. FIG. 34A depicts structural alignment of *E. coli* TadA (PDB:1z3a) and the predicted structure of MG68-4. tRNA structure was retrieved from *S. aureus* TadA (PDB: 2b3j). FIG. 34B depicts mutations identified from EcTadA for developments of adenine base editors (ABE7.10, ABE8.8m, ABE8.17m, and ABE8e) and equivalent residues of EcTadA on MG68-4. The mutations of EcTadA were installed to MG68-4 accordingly. H129N was identified from a bacterial selection in *E. coli*. In general, nuclear localization signal (SV40) was positioned on the C-terminus. For 2NLS constructs, one SV40 was used on the N-terminus and one SV40 was used on the C-terminus. For simplicity, deaminase sequences of adenine base editors are shown in the table. Abbreviations: MGA0.1, MG68-4; MGA1.1, MG68-4 (D109N); MGA2.1, MG68-4 (D109N/H129N); RD, rationally designed variants.

FIG. 35 (SEQ ID NO: 1792) depicts screening of adenine base editors in HEK293T cells. The top three variants are highlighted. The starting variant is MGA1.1. For 2NLS constructs, one SV40 was used on the N-terminus and one SV40 was used on the C-terminus. Abbreviations: MGA0.1, MG68-4; MGA1.1, MG68-4 (D109N); MGA2.1, MG68-4 (D109N/H129N); RD, rationally designed variants.

FIG. 36 depicts a table summarizing the base editing activity of rationally designed ABE variants described herein.

FIG. 37 depicts a gel-based deaminase assay showing activity of variant deaminases from several selected Families (MG93, MG139, and MG152). Enzymes were expressed in a bacterial (*E. coli* codon optimized) Purexpress cell lysate-derived in vitro transcription-translation system and incubated with 5'FAM-labeled ssDNA and USER enzyme (uracil DNA glycosylase and endonuclease VIII) at 37° C. for 2.5 h. The resulting DNA was resolved on a denaturing polyacrylamide gel and imaged. The positive control is a sequence with a U synthetically incorporated at the same position as the target C and the negative control is a sequence with no U or C.

FIG. 38A-FIG. 38C depicts a gel-based deaminase with dual fluorophore assay. FIG. 38A depicts a schematic of substrate design. Substrates were designed for minimal overlap between the two fluorophores. Emission for Cy3 is around 560 nm and the emission peak for Cy5.5 is around 700 nm. FIGS. 38B and 38C depict TBE-Urea Gel Images imaged using a Cy3 and Cy5.5 filter, respectively. RF157 is a single nucleotide substrate with a FAM molecule to act as a positive control to confirm the USER enzyme is cutting in the reaction and provide confirmation that the filter works and can discriminate between either fluorophore. A mastermix is used as a negative control to provide a baseline measurement for the uncut substrate. FIG. 38B: Deaminases that preferentially cut the substrate at T at the −1 position give a fluorescent product of 65 nts. Substrates cut at C at the −1 position give a product of 45 nts. Deaminases active on both C or T at the −1 position will give a product of 30 nts. FIG. 38C: Deaminase that preferentially cut substrate at G at the −1 position give a fluorescent product of 65 nts. Substrates cut at C at the −1 position give a product of 45 nts. Deaminases active on both A or G at the −1 position will give a product of 30 nts.

FIG. 39 depicts the percentage of deamination for each −1 position to the target Cytidine for each variant (MG93 and MG152 families) tested in this study.

FIG. 40 depicts the percentage of deamination for each −1 position to the target Cytidine for each variant (MG139 family) tested in this study.

FIG. 41A-FIG. 41C depicts a summary of activity data for novel and engineered CDAs as CBEs in mammalian cells. FIG. 41A depicts the maximum detected editing efficiency for all tested CDAs across 5 engineered spacers. FIG. 41B depicts the maximum detected activity normalized to internal positive control across 5 engineered spacers. The internal experimental positive control used for normalization was a highly active CDA "A0A2K5RDN7". FIG. 41C depicts side by side comparison of one of the lead candidates "139-52-V6" versus the highly active positive control "A0A2K5RDN7" with 2 guides. 139-52-V6 shows similar editing efficiencies in comparison to the highly active tested CDA.

FIG. 42 depicts the −1 nt preference of CDAs with more than 1% editing activity as CBEs in mammalian cells. The comparison of the −1 nt preference in mammalian cells vs in vitro is shown. −1 preference observed in mammalian cells as CBEs is by the most part comparable to the in vitro preference. The in vitro preference shows a more relaxed pattern than the CBE activity in mammalian cells.

FIG. 43A-FIG. 43C depicts an example of MG139-52 wt and mutated at N27 to A, MG139-52v6 that show differences of activity on ssDNA and/or on RNA:DNA duplex. FIG. 43A depicts a structural prediction of MG139-52 using A3H as template (pdb: 5W3V). The targeted mutation at N27 is indicated by an arrow and is located far away for the catalytic center and the recognition loop 7. FIG. 43B (SEQ ID NOs: 1824 and 1824-1837) depicts a cartoon showing the DNA/RNA heteroduplex in the R-loop that is targeted by 139-52 WT. CRISPResso output shows the G-A conversion indicative of deamination in the DNA strand forming a DNA/RNA heteroduplex. FIG. 43C (SEQ ID NOs: 1845, 1845, 1838, 1846-1849, 1839-1844, 1850-1852, 1881-1883, 1827 and 1884-1888) depicts CRISPREsso output showing that the G-A change in the DNA/RNA heteroduplex was abrogated with the N27A variant. Instead, such modification happens outside the DNA/RNA heteroduplex, suggesting that deamination in the DNA/RNA heteroduplex has been impaired.

FIG. 44 depicts the editing window of lead CDAs in comparison to the highly active CDA A0A2K5RDN7. The editing window shown corresponds to ~110 nts. The R loop (Cas9 target) is shown as a square. Lead candidates 152-6 and 139-52-V6 have smaller editing windows than A0A2K5RDN7, a favorable feature to avoid off target edits. Engineered CDA 139-52-V6 shows a smaller editing window than its WT counterpart 139-52.

FIG. 45 depicts the mammalian cytotoxicity of stably expressed CDAs as CBEs. CDAs, expressed as CBEs, were stably expressed in mammalian cells by lentiviral integration. The cytotoxicity was measured as fold change relative to a low activity low cytotoxic CDA (rAPOBEC). The lead candidates (high editing efficiency) show medium cytotoxic activity under these conditions. It is understood that the cytotoxic activity will be reduced when the system is expressed transiently.

FIG. 46A-FIG. 46B (SEQ ID NO: 1853) depicts the dimeric design of MG68-4 variants. FIG. 46A depicts the predicted structure of MG68-4 and structural alignment of MG68-4 with SaTadA (PDB code: 2b3j). The distance between N-terminus of the first monomer and C-terminus of the second monomer is shown. FIG. 46B (SEQ ID NO: 1853) depicts base editing efficiency comparing the monomeric and dimeric designs. TadA*8.8m was used for benchmarking. The target sequence is shown in the bar chart. Conversion of A to G was obtained from the highest editing position A8. All deaminases were fused to the N-terminus of MG34-1 (D10A). The editing was evaluated in HEK293T cells.

FIG. 47 (SEQ ID NOs: 1791-1792) depicts the effect of D109Q mutation to base substitution of C to G. A to G and C to G conversions were obtained from the target sequences 633 and 634, respectively. The editing efficiencies of residue C6 of target sequence 633 and residue A8 of target sequence 634 are shown. All deaminases were fused to the N-terminus of MG34-1 (D10A). The editing efficiency was evaluated in HEK293T cells.

FIG. 48 (SEQ ID NO: 1855) depicts base editing efficiency of the combinatorial library in HEK293T cells. Beneficial mutations identified from rational design and directed evolution were installed into MG68-4 to make the combinatorial library. The variants were inserted into 3-68_DIV30_M_RDr1v1_B. The editing efficiency was evaluated in HEK293T cells.

FIG. 49 (SEQ ID NO: 1856) depicts the effects of MG68-4 dimerization and/or MG68-4 amino acid sequence variants within the 3-68_DIV30 scaffold on A to G conversion percentage in HEK293T cells.

FIG. 50A-FIG. 50B depicts data demonstrating that the MG35-1 nickase can function as the scaffold of an adenine base editor in *E. Coli* cells. FIG. 50A depicts a schematic of the MG35-1 adenine base editor (ABE) containing a C-terminal TadA*-(7.10) monomer and an SV40 NLS fused to the C-terminus. FIG. 50B depicts a chloramphenicol selection experiment used to assess MG35-1 ABE base editing. A plasmid containing the MG35-1 ABE, a non-functional chloramphenicol acetyltransferase (CAT) gene, and a sgRNA that either targets the CAT gene (targeting sgRNA) or does not target the CAT gene (non-targeting sgRNA) are transformed into BL21(DE3) (Lucigen) *E. Coli* cells. *E. Coli* survival under chloramphenicol selection was dependent on the MG35-1 ABE editing the non-functional CAT gene to its wildtype sequence. Transformed *E. Coli* was plated on plates containing chloramphenicol concentrations of 0, 2, 3, 4, and 8 μg/mL. Plates also contained 100 μg/mL Carbecillin and 0.1 mM IPTG. Colonies grown on plates containing chloramphenicol concentrations of 0, 2, 3, 4, and 8 μg/mL were sequenced to assess reversion of the CAT gene. Experiments were performed as n=2.

FIG. 51 depicts the activity of 3-6/8 ABE at Apoa1. High A to G conversion was observed with 26 Apoa1 guides. For all spacers shown in the graph, base conversion at all A positions within the spacer region is shown.

FIG. 52 depicts the activity of 3-6/8 ABE at Angptl3. High A to G conversion was observed with 5 Angptl3 guides. For all spacers shown in the graph, base conversion at all A positions within the spacer region is shown.

FIG. 53 depicts the activity of 3-6/8 ABE at Trac. High A to G conversion was observed with 2 Trac guides. For all spacers shown in the graph, base conversion at all A positions within the spacer region is shown.

FIG. 54 depicts the background 3-6/8 ABE activity at Apoa1. Primer pairs for active guides were tested on mock-nucleofected samples to assay background editing at targeted regions. Scale is from 0 to 1%.

FIG. 55A-FIG. 55E depicts an *E. coli* survival assay with an nMG35-1 ABE. *E. coli* was transformed with a plasmid containing the nMG35-1-ABE, a non-functional chloramphenicol acetyltransferase (CAT Y193) gene, and an sgRNA that either targets the CAT gene (targeting spacer) or not (scramble spacer). FIG. 55A (SEQ ID NOs: 1821-1822 and 1819) depicts a diagram showing the target sequences with the expected TAM. Cell growth is dependent on the ABE base editing the non-functional CAT gene (A at position 17 from the TAM/PAM, boxed) to restore activity. FIGS. 55B-55E depicts the base editing activity in *E. coli* of base editors comprising nMG35-1 fused to the TadA deaminase with linkers of various lengths. The X axis shows the linkers listed in Table 14.

FIG. 56A-FIG. 56D depicts the evaluation of nMG35-1 ABE base editing in an *E. coli* survival assay under chloramphenicol selection, where cell growth is dependent on the ABE base editing the non-functional CAT gene stop codon and restoring activity. FIGS. 56A (SEQ ID NOs: 1857-1858, 1889 and 1859) and 56B (SEQ ID NOs: 1860-1861, 1890 and 1862) depict diagrams showing the target sequences with the expected TAM. The "A" base at position 11 (A) or 10 (B) from the TAM (boxes) is expected to edit to "G" in order to revert the stop codon to glutamine and restore chloramphenicol (cm) resistance. FIG. 56C: *E. coli* was transformed with a plasmid containing the nMG35-1-ABE, a non-functional chloramphenicol acetyltransferase (CAT), and an sgRNA that either targets the CAT gene (targeting spacer) or not (no spacer). Transformed *E. coli* was grown on plates containing chloramphenicol concentrations of 0, 2, 4, and 8 μg/mL. Plates also contained 100 μg/mL Carbecillin and 0.1 mM IPTG. The nMG35-1-ABE targeting both STOP98Q and STOP122Q contains both stop codons in the same gene that need to be reverted for CAT gene functionality. MIC: minimum inhibitory concentration. FIG. 56D (SEQ ID NOs: 1863-1864, 1891, 1865-1869, 1892-1893, 1866-1867 and 1866-1867) depicts Sanger sequencing chromatograms of five of 18 colonies grown at 2 μg/mL of chloramphenicol for the nMG35-1 ABE double reversion of STOP98Q and STOP122Q in the CAT gene. The chromatogram of the colony that does not show reversion (colony 3) reveals a smaller peak for A to G conversion that is likely obscured due to co-transformation with an unedited plasmid.

FIG. 57 depicts data demonstrating that truncation of the predicted PLMP domain at the N-terminus of MG35-1 ablates function of the MG35-1 ABE in *E. coli. E. coli* was transformed with a plasmid containing the nMG35-1-ABE, a non-functional chloramphenicol acetyltransferase (CAT), and an sgRNA that either targets the CAT gene (WT (top row) or PLMP domain truncation (bottom row) MG35-1 ABE) or a non-target spacer (middle row: WT MG35-1 ABE with a scrambled spacer). Transformed *E. coli* was grown on plates containing chloramphenicol concentrations of 0, 2 and 4 μg/mL. Plates also contained 100 μg/mL Carbecillin and 0.1 mM IPTG. MIC: minimum inhibitory concentration.

BRIEF DESCRIPTION OF THE SEQUENCE LISTING

Figure 1:
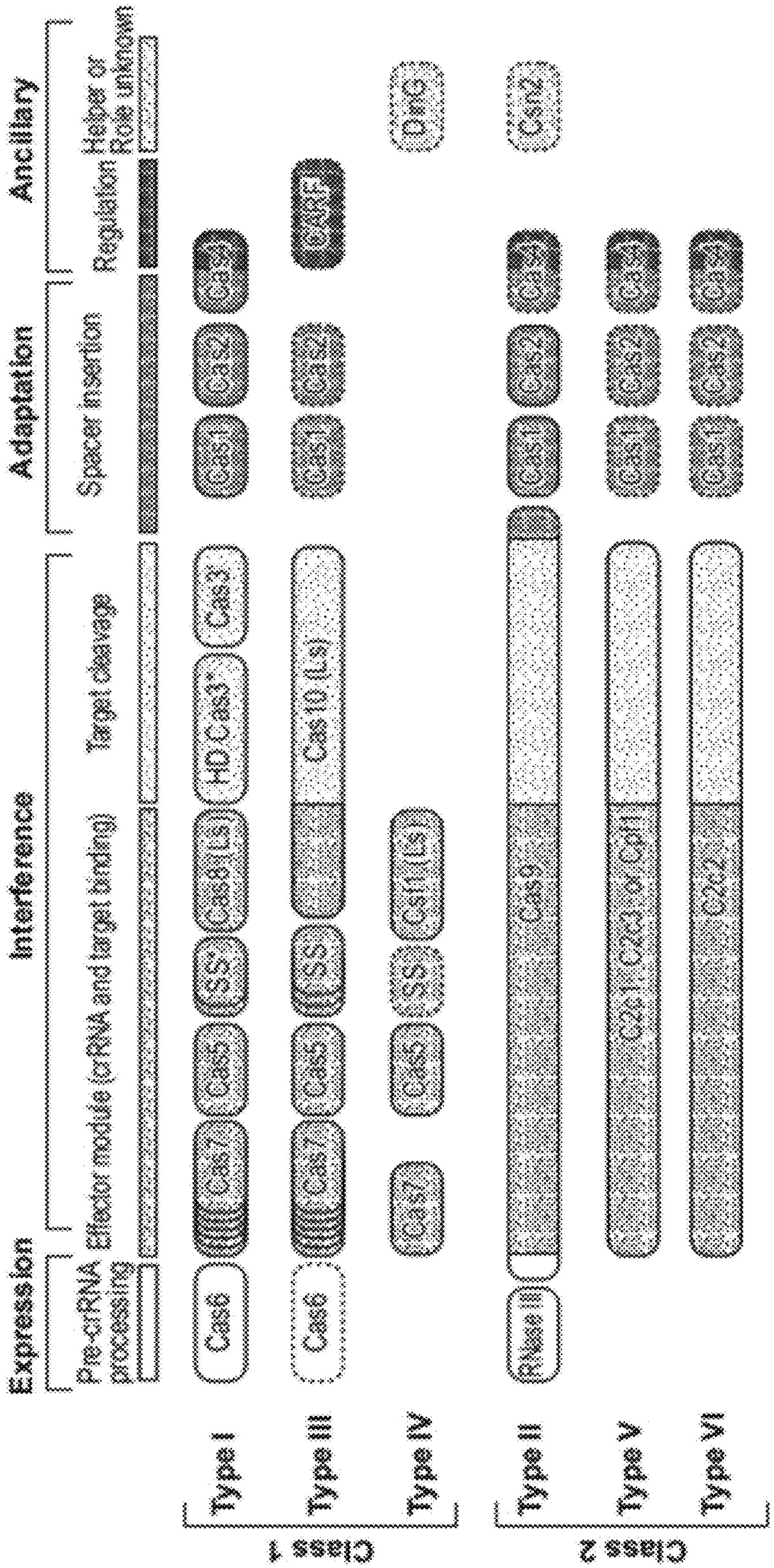
FIG. 1 depicts example organizations of CRISPR loci of different classes and types.

The Sequence Listing filed herewith provides exemplary polynucleotide and polypeptide sequences for use in methods, compositions and systems according to the disclosure. Below are exemplary descriptions of sequences therein.

SEQ ID NOs: 1-47 show the full-length peptide sequences of MG66 deaminases suitable for the engineered nucleic acid editing systems described herein.

SEQ ID NOs: 48-49 show the full-length peptide sequences of MG67 deaminases suitable for the engineered nucleic acid editing systems described herein.

SEQ ID NOs: 50-51 show the full-length peptide sequences of MG68 deaminases suitable for the engineered nucleic acid editing systems described herein.

SEQ ID NOs: 52-56 show the sequences of uracil DNA glycosylase inhibitors suitable for the engineered nucleic acid editing systems described herein.

SEQ ID NOs: 57-66 show the sequences of reference deaminases.

SEQ ID NO: 67 shows the sequence of a reference uracil DNA glycosylase inhibitor.

SEQ ID NO: 68 shows the sequence of an adenine base editor.

SEQ ID NO: 69 shows the sequence of a cytosine base editor.

SEQ ID NOs: 70-78 show the full-length peptide sequences of MG nickases suitable for the engineered nucleic acid editing systems described herein.

SEQ ID NOs: 79-87 shows the protospacer and PAM used in in vitro nickase assays described herein.

SEQ ID NOs: 88-96 show the peptide sequences of single guide RNA used in in vitro nickase assays described herein.

SEQ ID NOs: 97-156 show the sequences of spacers when targeting *E. coli* lacZ.

SEQ ID NOs: 157-176 show the sequences of primers when conducting site directed mutagenesis.

SEQ ID NOs: 177-178 show the sequences of primers for lacZ sequencing.

SEQ ID NOs: 179-342 show the sequences of primers used during amplification.

SEQ ID NOs: 343-345 show the sequences of primers for lacZ sequencing.

SEQ ID NOs: 346-359 show the sequences of primers used during amplification.

Sequence Numbers: A360-A368 show protospacer adjacent motifs suitable for the engineered nucleic acid editing systems described herein.

SEQ ID NOs: 369-384 show nuclear localization sequences (NLS's) suitable for the engineered nucleic acid editing systems described herein.

SEQ ID NOs: 385-443 show the full-length peptide sequences of MG68 deaminases suitable for the engineered nucleic acid editing systems described herein.

SEQ ID NOs: 444-447 show the full-length peptide sequences of MG121 deaminases suitable for the engineered nucleic acid editing systems described herein.

SEQ ID NOs: 448-475 show the full-length peptide sequences of MG68 deaminases suitable for the engineered nucleic acid editing systems described herein.

SEQ ID NOs: 476 and 477 show sequences of adenine base editors.

SEQ ID NOs: 478-482 show sequences of cytosine base editors.

SEQ ID NOs: 483-487 show the sequences of plasmids suitable for encoding the engineered nucleic acid editing systems described herein.

SEQ ID NOs: 488 and 489 show the sgRNA scaffold sequences for MG15-1 and MG34-1.

SEQ ID NOs: 490-522 show the sequences of spacers used to target genomic loci in *E. coli* and HEK293T cells.

SEQ ID NOs: 523-585 show the sequences of primers used during amplification and Sanger sequencing.

SEQ ID NOs: 584-585 show the sequences of primers used during amplification.

SEQ ID NO: 586 shows the sequence of an adenine base editor.

SEQ ID NO: 587 shows the sequence of a cytosine base editor.

SEQ ID NOs: 588-589 show sequences of adenine base editors.

SEQ ID NOs: 590-593 show the full-length peptide sequences of linkers suitable for the engineered nucleic acid editing systems described herein.

SEQ ID NO: 594 shows the sequence of a cytidine deaminase.

SEQ ID NO: 595 shows the sequence of an adenosine deaminase.

SEQ ID NO: 596 shows the sequence of an MG34 active effector suitable for the engineered nucleic acid editing systems described herein.

SEQ ID NO: 597 shows the sequence of an MG34 nickase suitable for the engineered nucleic acid editing systems described herein.

Sequence Number: A598 shows the sequence of an MG34 PAM.

SEQ ID NOs: 599-638 show the full-length peptide sequences of MG138 cytidine deaminases suitable for the engineered nucleic acid editing systems described herein.

SEQ ID NOs: 639-659 show the full-length peptide sequences of MG139 cytidine deaminases suitable for the engineered nucleic acid editing systems described herein.

SEQ ID NOs: 660-662 show the full-length peptide sequences of MG141 cytidine deaminases suitable for the engineered nucleic acid editing systems described herein.

SEQ ID NOs: 663-664 show the full-length peptide sequences of MG142 cytidine deaminases suitable for the engineered nucleic acid editing systems described herein.

SEQ ID NOs: 665-675 show the full-length peptide sequences of MG93 cytidine deaminases suitable for the engineered nucleic acid editing systems described herein.

SEQ ID NOs: 676-678 show sequences of adenine base editors.

SEQ ID NOs: 679-680 show the sgRNA scaffold sequences for MG34-1 and SpCas9.

SEQ ID NOs: 681-689 show spacer sequences used to target genomic loci in guide RNAs.

SEQ ID NOs: 690-707 show sequences of primers used to amplify genomic targets of adenine bae editors (ABE) for next generation sequencing (NGS) analysis.

SEQ ID NO: 708 shows the sequence of a blasticidin (BSD) resistance cassette.

SEQ ID NOs: 709-719 show spacer sequences used to target genomic loci in guide RNAs.

SEQ ID NOs: 720-726 show the sequences of plasmids suitable for encoding the engineered nucleic acid editing systems described herein.

SEQ ID NOs: 728-729 show sequences of adenine base editors.

SEQ ID NOs: 730-736 show spacer sequences used to target genomic loci in guide RNAs.

SEQ ID NOs: 737-738 show the sequences of plasmids suitable for encoding the engineered nucleic acid editing systems described herein.

SEQ ID NOs: 739-740 show sequences of cytidine base editors.

SEQ ID NO: 741 shows the sequence of a plasmid suitable for encoding the A1CF gene.

SEQ ID NO: 742 shows the sequence of an RNA used to test CDAs for RNA activity.

SEQ ID NO: 743 shows the sequence of a labelled primer for poisoned primer extension assay used to test CDAs for RNA activity.

SEQ ID NOs: 744-827 show the full-length peptide sequences of MG139 cytidine deaminases suitable for the engineered nucleic acid editing systems described herein.

SEQ ID NO: 828 shows the full-length peptide sequence of an MG93 cytidine deaminase suitable for the engineered nucleic acid editing systems described herein.

SEQ ID NO: 829 shows the full-length peptide sequence of an MG142 cytidine deaminase suitable for the engineered nucleic acid editing systems described herein.

SEQ ID NOs: 830-835 show the full-length peptide sequences of MG152 cytidine deaminases suitable for the engineered nucleic acid editing systems described herein.

SEQ ID NOs: 836-860 show sequences of adenine base editors.

SEQ ID NOs: 861-864 show spacer sequences used to target genomic loci in guide RNAs.

SEQ ID NOs: 865-872 show sequences of primers used to amplify genomic targets of adenine bae editors (ABE) for next generation sequencing (NGS) analysis.

SEQ ID NOs: 873-875 show the sequences of plasmids suitable for encoding the engineered nucleic acid editing systems described herein.

SEQ ID NO: 876 shows the sgRNA scaffold sequence for MG34-1.

SEQ ID NOs: 877-916 show sequences of cytosine base editors.

SEQ ID NOs: 917-931 show the sequences of sgRNAs suitable for the engineered nucleic acid editing systems described herein.

SEQ ID NOs: 932-961 show sequences of primers used to amplify genomic targets of adenine base editors (ABE) for next generation sequencing (NGS) analysis.

SEQ ID NO: 962 shows a site engineered in mammalian cell line with 5 PAMs compatible with Cas9 and MG3-6 editing.

SEQ ID NOs: 963-967 show the sequences of sgRNAs suitable for the engineered nucleic acid editing systems described herein.

SEQ ID NOs: 968-969 show sequences of cytosine base editors.

SEQ ID NO: 970 shows the full-length peptide sequence of an MG139 cytidine deaminase suitable for the engineered nucleic acid editing systems described herein.

SEQ ID NOs: 971-977 show the full-length peptide sequences of MG93 cytidine deaminases suitable for the engineered nucleic acid editing systems described herein.

SEQ ID NOs: 978-981 show the full-length peptide sequences of MG138 cytidine deaminases suitable for the engineered nucleic acid editing systems described herein.

SEQ ID NO: 982 shows the full-length peptide sequence of MG142 cytidine deaminase suitable for the engineered nucleic acid editing systems described herein.

SEQ ID NO: 983-1014 shows the full-length peptide sequence of MG128 deaminases suitable for the engineered nucleic acid editing systems described herein.

SEQ ID NO: 1015-1026 shows the full-length peptide sequence of MG129 deaminases suitable for the engineered nucleic acid editing systems described herein.

SEQ ID NO: 1027-1031 shows the full-length peptide sequence of MG130 deaminases suitable for the engineered nucleic acid editing systems described herein.

SEQ ID NO: 1032-1040 shows the full-length peptide sequence of MG131 deaminases suitable for the engineered nucleic acid editing systems described herein.

SEQ ID NO: 1041-1043 shows the full-length peptide sequence of MG132 deaminases suitable for the engineered nucleic acid editing systems described herein.

SEQ ID NO: 1044-1057 shows the full-length peptide sequence of MG133 deaminases suitable for the engineered nucleic acid editing systems described herein.

SEQ ID NO: 1058-1061 shows the full-length peptide sequence of MG134 deaminases suitable for the engineered nucleic acid editing systems described herein.

SEQ ID NO: 1062-1069 shows the full-length peptide sequence of MG135 deaminases suitable for the engineered nucleic acid editing systems described herein.

SEQ ID NO: 1070-1081 shows the full-length peptide sequence of MG136 deaminases suitable for the engineered nucleic acid editing systems described herein.

SEQ ID NO: 1082-1098 shows the full-length peptide sequence of MG137 deaminases suitable for the engineered nucleic acid editing systems described herein.

SEQ ID NOs: 1099-1105 show the sequences of sgRNAs suitable for the engineered nucleic acid editing systems described herein.

SEQ ID NOs: 1106-1111 show the sequences of MG35 PAMs.

SEQ ID NO: 1112 shows the DNA sequence of a gene encoding the ABE-MG35-1 adenine base editor.

SEQ ID NO: 1113 shows the protein sequence of the ABE-MG35-1 adenine base editor.

SEQ ID NO: 1114 shows the nucleotide sequence of a plasmid encoding a Cas9-based cytosine base editor (CBE).

SEQ ID NO: 1115 shows the nucleotide sequence of a plasmid encoding Fam72a.

SEQ ID NOs: 1116-1117 show the sequences of Cas9-CBE target sites.

SEQ ID NOs: 1118-1119 show the sequences of NGS amplicons.

SEQ ID NO: 1120 shows the full-length peptide sequence of an MG35 nuclease.

SEQ ID NO: 1121 shows the full-length peptide sequence of Fam72A.

SEQ ID NOs: 1121-1127 shows the full-length peptide sequences of MG35 nucleases.

SEQ ID NOs: 1128-1160 shows the full-length peptide sequences of MG3-6/3-8 adenine base editors.

SEQ ID NOs: 1161-1186 shows the full-length peptide sequences of MG34-1 adenine base editors.

SEQ ID NOs: 1187-1195 show the sequences of sgRNAs suitable for the engineered nucleic acid editing systems described herein.

SEQ ID NOs: 1196-1204 show spacer sequences used to target genomic loci in guide RNAs.

SEQ ID NO: 1205 shows the nucleotide sequence of a plasmid encoding an MG3-6/3-8 adenine base editor.

SEQ ID NO: 1206 shows the nucleotide sequence of a plasmid encoding an sgRNA suitable for an MG3-6/3-8 adenine base editor described herein.

SEQ ID NO: 1207 shows the nucleotide sequence of a plasmid encoding an MG34-1 adenine base editor.

SEQ ID NOs: 1208-1269 show the full-length peptide sequences of MG93 deaminases suitable for the engineered nucleic acid editing systems described herein.

SEQ ID NOs: 1270-1296 show the full-length peptide sequences of MG139 deaminases suitable for the engineered nucleic acid editing systems described herein.

SEQ ID NOs: 1297-1311 show the full-length peptide sequences of MG152 deaminases suitable for the engineered nucleic acid editing systems described herein.

SEQ ID NOs: 1312-1313 show the full-length peptide sequences of MG138 deaminases suitable for the engineered nucleic acid editing systems described herein.

SEQ ID NOs: 1314-1315 show the full-length peptide sequences of MG139 deaminases suitable for the engineered nucleic acid editing systems described herein.

SEQ ID NOs: 1316-1319 show the nucleotide sequences of 5'-FAM-labeled ssDNAs.

SEQ ID NOs: 1320-1321 show the nucleotide sequences of Cy5.5-labeled ssDNAs.

SEQ ID NOs: 1322-1355 show sequences of cytidine base editors.

SEQ ID NOs: 1356-1362 show the full-length peptide sequences of MG34-1 adenine base editors.

SEQ ID NOs: 1363-1415 show the full-length peptide sequences of MG3-6/3-8 adenine base editors.

SEQ ID NOs: 1416-1417 show the nucleotide sequences of sgRNAs suitable for use with MG34-1 adenine base editors described herein.

SEQ ID NO: 1418 shows the nucleotide sequence of an sgRNA suitable for use with MG3-6/3-8 adenine base editors described herein.

SEQ ID NOs: 1419-1420 show the DNA sequences of target sites suitable for targeting by MG34-1 adenine base editors described herein.

SEQ ID NO: 1421 shows a DNA sequence of a target site suitable for targeting by MG3-6/3-8 adenine base editors described herein.

SEQ ID NO: 1422 shows the nucleotide sequence of a plasmid suitable for expression of an MG34-1 adenine base editor described herein.

SEQ ID NO: 1423 shows the nucleotide sequence of a plasmid suitable for expression of an MG3-6/3-8 adenine base editor described herein.

SEQ ID NO: 1424 shows the full-length peptide sequence of an MG35-1 adenine base editor.

SEQ ID NO: 1425-1426 show the nucleotide sequences of plasmids suitable for expression of MG35-1 adenine base editors and sgRNAs described herein.

SEQ ID NOs: 1427-1428 show the nucleotide sequences of sgRNAs suitable for use with MG35-1 adenine base editors described herein.

SEQ ID NOs: 1429-1430 show the DNA sequences of target sites suitable for targeting by MG35-1 adenine base editors described herein.

SEQ ID NOs: 1431-1454 show the nucleotide sequences of sgRNAs engineered to function with an MG3-6/3-8 adenine base editor in order to target APOA1.

SEQ ID NOs: 1455-1478 show the DNA sequences of APOA1 target sites.

SEQ ID NOs: 1479-1483 show the nucleotide sequences of sgRNAs engineered to function with an MG3-6/3-8 adenine base editor in order to target ANGPTL3.

SEQ ID NOs: 1484-1488 show the DNA sequences of ANGPTL3 target sites.

SEQ ID NOs: 1489-1490 show the nucleotide sequences of sgRNAs engineered to function with an MG3-6/3-8 adenine base editor in order to target TRAC.

SEQ ID NOs: 1491-1492 show the DNA sequences of TRAC sites.

SEQ ID NOs: 1493-1516 show the nucleotide sequences of NGS primers suitable for use in assessing base editing of APOA1.

SEQ ID NOs: 1517-1521 show the nucleotide sequences of NGS primers suitable for use in assessing base editing of ANGPTL3.

SEQ ID NOs: 1522-1523 show the nucleotide sequences of NGS primers suitable for use in assessing base editing of TRAC.

SEQ ID NOs: 1524-1547 show the nucleotide sequences of NGS primers suitable for use in assessing base editing of APOA1.

SEQ ID NOs: 1548-1552 show the nucleotide sequences of NGS primers suitable for use in assessing base editing of ANGPTL3.

SEQ ID NOs: 1553-1554 show the nucleotide sequences of NGS primers suitable for use in assessing base editing of TRAC.

SEQ ID NO: 1555 shows the nucleotide sequence of a plasmid suitable for use in mRNA production.

SEQ ID NOs: 1556-1562 show the full-length peptide sequences of MG131 adenine deaminase variants.

SEQ ID NOs: 1563-1566 show the full-length peptide sequences of MG134 adenine deaminase variants.

SEQ ID NOs: 1567-1574 show the full-length peptide sequences of MG135 adenine deaminase variants.

SEQ ID NOs: 1575-1589 show the full-length peptide sequences of MG137 adenine deaminase variants.

SEQ ID NOs: 1590-1599 show the full-length peptide sequences of MG68 adenine deaminase variants.

SEQ ID NOs: 1600-1602 show the full-length peptide sequences of MG132 adenine deaminase variants.

SEQ ID NOs: 1603-1616 show the full-length peptide sequences of MG133 adenine deaminase variants.

SEQ ID NOs: 1617-1624 show the full-length peptide sequences of MG136 adenine deaminase variants.

SEQ ID NOs: 1625-1633 show the full-length peptide sequences of MG129 adenine deaminase variants.

SEQ ID NOs: 1634-1638 show the full-length peptide sequences of MG130 adenine deaminase variants.

SEQ ID NOs: 1639-1644 show the full-length peptide sequences of MG34-1 adenine base editors.

SEQ ID NOs: 1645-1646 show the nucleotide sequences of ssDNA substrates suitable for testing adenine deaminase activity in vitro.

DETAILED DESCRIPTION

While various embodiments of the invention have been shown and described herein, it will be obvious to those skilled in the art that such embodiments are provided by way of example only. Numerous variations, changes, and substitutions may occur to those skilled in the art without departing from the invention. It should be understood that various alternatives to the embodiments of the invention described herein may be employed.

The practice of some methods disclosed herein employ, unless otherwise indicated, techniques of immunology, biochemistry, chemistry, molecular biology, microbiology, cell biology, genomics and recombinant DNA. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)) (which is entirely incorporated by reference herein).

As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description or the claims, such terms are intended to be inclusive in a manner similar to the term "comprising."

The term "about" or "approximately" means within an acceptable error range for the particular value as determined by one of ordinary skill in the art, which will depend in part on how the value is measured or determined, i.e., the limitations of the measurement system. For example, "about" can mean within one or more than one standard deviation, per the practice in the art. Alternatively, "about" can mean a range of up to 20%, up to 15%, up to 10%, up to 5%, or up to 1% of a given value.

As used herein, a "cell" generally refers to a biological cell. A cell may be the basic structural, functional or biological unit of a living organism. A cell may originate from any organism having one or more cells. Some non-limiting examples include: a prokaryotic cell, eukaryotic cell, a bacterial cell, an archaeal cell, a cell of a single-cell eukaryotic organism, a protozoa cell, a cell from a plant (e.g., cells from plant crops, fruits, vegetables, grains, soy bean, corn, maize, wheat, seeds, tomatoes, rice, cassava, sugarcane, pumpkin, hay, potatoes, cotton, *cannabis*, tobacco, flowering plants, conifers, gymnosperms, ferns, clubmosses, hornworts, liverworts, mosses), an algal cell, (e.g., *Botryococcus braunii, Chlamydomonas reinhardtii, Nannochloropsis gaditana, Chlorella pyrenoidosa, Sargassum patens* C. Agardh, and the like), seaweeds (e.g., kelp), a fungal cell (e.g., a yeast cell, a cell from a mushroom), an animal cell, a cell from an invertebrate animal (e.g., fruit fly, cnidarian, echinoderm, nematode, etc.), a cell from a vertebrate animal (e.g., fish, amphibian, reptile, bird, mammal), a cell from a mammal (e.g., a pig, a cow, a goat, a sheep, a rodent, a rat, a mouse, a non-human primate, a human, etc.), and etcetera. Sometimes a cell is not originating from a natural organism (e.g., a cell can be a synthetically made, sometimes termed an artificial cell).

The term "nucleotide," as used herein, generally refers to a base-sugar-phosphate combination. A nucleotide may comprise a synthetic nucleotide. A nucleotide may comprise a synthetic nucleotide analog. Nucleotides may be monomeric units of a nucleic acid sequence (e.g., deoxyribonucleic acid (DNA) and ribonucleic acid (RNA)). The term nucleotide may include ribonucleoside triphosphates adenosine triphosphate (ATP), uridine triphosphate (UTP), cytosine triphosphate (CTP), guanosine triphosphate (GTP) and deoxyribonucleoside triphosphates such as dATP, dCTP, dITP, dUTP, dGTP, dTTP, or derivatives thereof. Such derivatives may include, for example, [αS]dATP, 7-deaza-dGTP and 7-deaza-dATP, and nucleotide derivatives that confer nuclease resistance on the nucleic acid molecule containing them. The term nucleotide as used herein may refer to dideoxyribonucleoside triphosphates (ddNTPs) and their derivatives. Illustrative examples of dideoxyribonucleoside triphosphates may include, but are not limited to, ddATP, ddCTP, ddGTP, ddITP, and ddTTP. A nucleotide may be unlabeled or detectably labeled, such as using moieties comprising optically detectable moieties (e.g., fluorophores). Labeling may also be carried out with quantum dots. Detectable labels may include, for example, radioactive isotopes, fluorescent labels, chemiluminescent labels, bioluminescent labels and enzyme labels. Fluorescent labels of nucleotides may include but are not limited fluorescein, 5-carboxyfluorescein (FAM), 2'7'-dimethoxy-4'5-dichloro-6-carboxyfluorescein (JOE), rhodamine, 6-carboxyrhodamine (R6G), N,N,N',N'-tetramethyl-6-carboxyrhodamine (TAMRA), 6-carboxy-X-rhodamine (ROX), 4-(4'dimethylaminophenylazo) benzoic acid (DABCYL), Cascade Blue, Oregon Green, Texas Red, Cyanine and 5-(2'-aminoethyl) aminonaphthalene-1-sulfonic acid (EDANS). Specific examples of fluorescently labeled nucleotides can include [R6G]dUTP, [TAMRA]dUTP, [R110]dCTP, [R6G]dCTP, [TAMRA]dCTP, [JOE]ddATP, [R6G]ddATP, [FAM]ddCTP, [R110]ddCTP, [TAMRA]ddGTP, [ROX]ddTTP, [dR6G]ddATP, [dR110]ddCTP, [dTAMRA]ddGTP, and [dROX]ddTTP available from Perkin Elmer, Foster City, Calif; FluoroLink DeoxyNucleotides, FluoroLink Cy3-dCTP, FluoroLink Cy5-dCTP, FluoroLink Fluor X-dCTP, FluoroLink Cy3-dUTP, and FluoroLink Cy5-dUTP available from Amersham, Arlington Heights, Ill.; Fluorescein-15-dATP, Fluorescein-12-dUTP, Tetramethyl-rodamine-6-dUTP, IR770-9-dATP, Fluorescein-12-ddUTP, Fluorescein-12-UTP, and Fluorescein-15-2'-dATP available from Boehringer Mannheim, Indianapolis, Ind.; and Chromosome Labeled Nucleotides, BODIPY-FL-14-UTP, BODIPY-FL-4-UTP, BODIPY-TMR-14-UTP, BODIPY-TMR-14-dUTP, BODIPY-TR-14-UTP, BODIPY-TR-14-dUTP, Cascade Blue-7-UTP, Cascade Blue-7-dUTP, fluorescein-12-UTP, fluorescein-12-dUTP, Oregon Green 488-5-dUTP, Rhodamine Green-5-UTP, Rhodamine Green-5-dUTP, tetramethylrhodamine-6-UTP, tetramethylrhodamine-6-dUTP, Texas Red-5-UTP, Texas Red-5-dUTP, and Texas Red-12-dUTP available from Molecular Probes, Eugene, Oreg. Nucleotides can also be labeled or marked by chemical modification. A chemically-modified single nucleotide can be biotin-dNTP. Some non-limiting examples of biotinylated dNTPs can include, biotin-dATP (e.g., bio-N6-ddATP, biotin-14-dATP), biotin-dCTP (e.g., biotin-11-dCTP, biotin-14-dCTP), and biotin-dUTP (e.g., biotin-11-dUTP, biotin-16-dUTP, biotin-20-dUTP).

The terms "polynucleotide," "oligonucleotide," and "nucleic acid" are used interchangeably to generally refer to a polymeric form of nucleotides of any length, either deoxyribonucleotides or ribonucleotides, or analogs thereof, either in single-, double-, or multi-stranded form. A polynucleotide may be exogenous or endogenous to a cell. A polynucleotide may exist in a cell-free environment. A polynucleotide may be a gene or fragment thereof. A polynucleotide may be DNA. A polynucleotide may be RNA. A polynucleotide may have any three-dimensional structure and may perform any function. A polynucleotide may comprise one or more analogs (e.g., altered backbone, sugar, or nucleobase). If present, modifications to the nucleotide structure may be imparted before or after assembly of the polymer. Some non-limiting examples of analogs include: 5-bromouracil, peptide nucleic acid, xeno nucleic acid, morpholinos, locked nucleic acids, glycol nucleic acids, threose nucleic acids, dideoxynucleotides, cordycepin, 7-deaza-GTP, fluorophores (e.g., rhodamine or fluorescein linked to the sugar), thiol containing nucleotides, biotin linked nucleotides, fluorescent base analogs, CpG islands, methyl-7-guanosine, methylated nucleotides, inosine, thiouridine, pseudouridine, dihydrouridine, queuosine, and wyosine. Non-limiting examples of polynucleotides include coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, cell-free polynucleotides including cell-free DNA (cfDNA) and cell-free RNA (cfRNA), nucleic acid probes, and primers. The sequence of nucleotides may be interrupted by non-nucleotide components.

The terms "transfection" or "transfected" generally refer to introduction of a nucleic acid into a cell by non-viral or viral-based methods. The nucleic acid molecules may be gene sequences encoding complete proteins or functional portions thereof. See, e.g., Sambrook et al., 1989, Molecular Cloning: A Laboratory Manual, 18.1-18.88.

The terms "peptide," "polypeptide," and "protein" are used interchangeably herein to generally refer to a polymer of at least two amino acid residues joined by peptide bond(s). This term does not connote a specific length of polymer, nor is it intended to imply or distinguish whether the peptide is produced using recombinant techniques, chemical or enzymatic synthesis, or is naturally occurring. The terms apply to naturally occurring amino acid polymers as well as amino acid polymers comprising at least one modified amino acid. In some cases, the polymer may be interrupted by non-amino acids. The terms include amino acid chains of any length, including full length proteins, and proteins with or without secondary or tertiary structure (e.g., domains). The terms also encompass an amino acid polymer that has been modified, for example, by disulfide bond formation, glycosylation, lipidation, acetylation, phosphorylation, oxidation, and any other manipulation such as conjugation with a labeling component. The terms "amino acid" and "amino acids," as used herein, generally refer to natural and non-natural amino acids, including, but not limited to, modified amino acids and amino acid analogues. Modified amino acids may include natural amino acids and non-natural amino acids, which have been chemically modified to include a group or a chemical moiety not naturally present on the amino acid. Amino acid analogues may refer to amino acid derivatives. The term "amino acid" includes both D-amino acids and L-amino acids.

As used herein, the "non-native" can generally refer to a nucleic acid or polypeptide sequence that is not found in a native nucleic acid or protein. Non-native may refer to affinity tags. Non-native may refer to fusions. Non-native may refer to a naturally occurring nucleic acid or polypeptide sequence that comprises mutations, insertions or deletions. A non-native sequence may exhibit or encode for an activity (e.g., enzymatic activity, methyltransferase activity, acetyltransferase activity, kinase activity, ubiquitinating activity, etc.) that may also be exhibited by the nucleic acid or polypeptide sequence to which the non-native sequence is fused. A non-native nucleic acid or polypeptide sequence may be linked to a naturally-occurring nucleic acid or polypeptide sequence (or a variant thereof) by genetic engineering to generate a chimeric nucleic acid or polypeptide sequence encoding a chimeric nucleic acid or polypeptide.

The term "promoter", as used herein, generally refers to the regulatory DNA region which controls transcription or expression of a gene and which may be located adjacent to or overlapping a nucleotide or region of nucleotides at which RNA transcription is initiated. A promoter may contain specific DNA sequences which bind protein factors, often referred to as transcription factors, which facilitate binding of RNA polymerase to the DNA leading to gene transcription. A 'basal promoter', also referred to as a 'core promoter', may generally refer to a promoter that contains all the basic elements to promote transcriptional expression of an operably linked polynucleotide. Eukaryotic basal promoters can contain a TATA-box or a CAAT box.

The term "expression", as used herein, generally refers to the process by which a nucleic acid sequence or a polynucleotide is transcribed from a DNA template (such as into mRNA or other RNA transcript) or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

As used herein, "operably linked", "operable linkage", "operatively linked", or grammatical equivalents thereof generally refer to juxtaposition of genetic elements, e.g., a promoter, an enhancer, a polyadenylation sequence, etc., wherein the elements are in a relationship permitting them to operate in the expected manner. For instance, a regulatory element, which may comprise promoter or enhancer sequences, is operatively linked to a coding region if the regulatory element helps initiate transcription of the coding sequence. There may be intervening residues between the regulatory element and coding region so long as this functional relationship is maintained.

A "vector" as used herein, generally refers to a macromolecule or association of macromolecules that comprises or associates with a polynucleotide and which may be used to mediate delivery of the polynucleotide to a cell. Examples of vectors include plasmids, viral vectors, liposomes, and other gene delivery vehicles. The vector generally comprises genetic elements, e.g., regulatory elements, operatively linked to a gene to facilitate expression of the gene in a target.

As used herein, "an expression cassette" and "a nucleic acid cassette" are used interchangeably generally to refer to a combination of nucleic acid sequences or elements that are expressed together or are operably linked for expression. In some cases, an expression cassette refers to the combination of regulatory elements and a gene or genes to which they are operably linked for expression.

A "functional fragment" of a DNA or protein sequence generally refers to a fragment that retains a biological activity (either functional or structural) that is substantially similar to a biological activity of the full-length DNA or protein sequence. A biological activity of a DNA sequence may be its ability to influence expression in a manner attributed to the full-length sequence.

As used herein, an "engineered" object generally indicates that the object has been modified by human intervention. According to non-limiting examples: a nucleic acid may be modified by changing its sequence to a sequence that does not occur in nature; a nucleic acid may be modified by ligating it to a nucleic acid that it does not associate with in nature such that the ligated product possesses a function not present in the original nucleic acid; an engineered nucleic acid may synthesized in vitro with a sequence that does not exist in nature; a protein may be modified by changing its amino acid sequence to a sequence that does not exist in nature; an engineered protein may acquire a new function or property. An "engineered" system comprises at least one engineered component.

As used herein, "synthetic" and "artificial" are used interchangeably to refer to a protein or a domain thereof that has low sequence identity (e.g., less than 50% sequence identity, less than 25% sequence identity, less than 10% sequence identity, less than 5% sequence identity, less than 1% sequence identity) to a naturally occurring human protein. For example, VPR and VP64 domains are synthetic transactivation domains.

The term "tracrRNA" or "tracr sequence", as used herein, can generally refer to a nucleic acid with at least about 5%, 10%, 20%, 30%, 40%, 50%, 60%, 70%, 80%, 90%, 95%, or 100% sequence identity or sequence similarity to a wild type example tracrRNA sequence (e.g., a tracrRNA from *S. pyogenes S. aureus*, etc.). tracrRNA can refer to a nucleic acid with at most about 5%, 10%, 20%, 30%, 40%, 50%, 60%, 70%, 80%, 90%, or 100% sequence identity or sequence similarity to a wild type example tracrRNA sequence (e.g., a tracrRNA from *S. pyogenes S. aureus*, etc.). tracrRNA may refer to a modified form of a tracrRNA that can comprise a nucleotide change such as a deletion, insertion, or substitution, variant, mutation, or chimera. A tracrRNA may refer to a nucleic acid that can be at least about 60% identical to a wild type example tracrRNA (e.g., a tracrRNA from *S. pyogenes S. aureus*, etc.) sequence over a stretch of at least 6 contiguous nucleotides. For example, a tracrRNA sequence can be at least about 60% identical, at least about 65% identical, at least about 70% identical, at least about 75% identical, at least about 80% identical, at least about 85% identical, at least about 90% identical, at least about 95% identical, at least about 98% identical, at least about 99% identical, or 100% identical to a wild type example tracrRNA (e.g., a tracrRNA from *S. pyogenes S. aureus*, etc.) sequence over a stretch of at least 6 contiguous nucleotides. Type II tracrRNA sequences can be predicted on a genome sequence by identifying regions with complementarity to part of the repeat sequence in an adjacent CRISPR array.

As used herein, a "guide nucleic acid" can generally refer to a nucleic acid that may hybridize to another nucleic acid. A guide nucleic acid may be RNA. A guide nucleic acid may be DNA. The guide nucleic acid may be programmed to bind to a sequence of nucleic acid site-specifically. The nucleic acid to be targeted, or the target nucleic acid, may comprise nucleotides. The guide nucleic acid may comprise nucleotides. A portion of the target nucleic acid may be complementary to a portion of the guide nucleic acid. The strand of a double-stranded target polynucleotide that is complementary to and hybridizes with the guide nucleic acid may be called the complementary strand. The strand of the double-stranded target polynucleotide that is complementary to the complementary strand, and therefore may not be complementary to the guide nucleic acid may be called noncomplementary strand. A guide nucleic acid may comprise a polynucleotide chain and can be called a "single guide nucleic acid." A guide nucleic acid may comprise two polynucleotide chains and may be called a "double guide nucleic acid." If not otherwise specified, the term "guide nucleic acid" may be inclusive, referring to both single guide nucleic acids and double guide nucleic acids. A guide nucleic acid may comprise a segment that can be referred to as a "nucleic acid-targeting segment" or a "nucleic acid-targeting sequence." A nucleic acid-targeting segment may comprise a sub-segment that may be referred to as a "protein binding segment" or "protein binding sequence" or "Cas protein binding segment".

The term "sequence identity" or "percent identity" in the context of two or more nucleic acids or polypeptide sequences, generally refers to two (e.g., in a pairwise alignment) or more (e.g., in a multiple sequence alignment) sequences that are the same or have a specified percentage of amino acid residues or nucleotides that are the same, when compared and aligned for maximum correspondence over a local or global comparison window, as measured using a sequence comparison algorithm. Suitable sequence comparison algorithms for polypeptide sequences include, e.g., BLASTP using parameters of a wordlength (W) of 3, an expectation (E) of 10, and the BLOSUM62 scoring matrix setting gap costs at existence of 11, extension of 1, and using a conditional compositional score matrix adjustment for polypeptide sequences longer than 30 residues; BLASTP using parameters of a wordlength (W) of 2, an expectation (E) of 1000000, and the PAM30 scoring matrix setting gap costs at 9 to open gaps and 1 to extend gaps for sequences of less than 30 residues (these are the default parameters for BLASTP in the BLAST suite available at blast.ncbi.nlm.nih.gov); CLUSTALW with parameters of; the Smith-Waterman homology search algorithm with parameters of a match of 2, a mismatch of −1, and a gap of −1; MUSCLE with default parameters; MAFFT with parameters retree of 2 and maxiterations of 1000; Novafold with default parameters; HMMER hmmalign with default parameters.

As used herein, the term "RuvC III domain" generally refers to a third discontinuous segment of a RuvC endonuclease domain (the RuvC nuclease domain being comprised of three discontiguous segments, RuvC_I, RuvC_II, and RuvC_III). A RuvC domain or segments thereof can generally be identified by alignment to documented domain sequences, structural alignment to proteins with annotated domains, or by comparison to Hidden Markov Models (HMMs) built based on documented domain sequences (e.g., Pfam HMM PF18541 for RuvC III).

As used herein, the term "HNH domain" generally refers to an endonuclease domain having characteristic histidine and asparagine residues. An HNH domain can generally be identified by alignment to documented domain sequences, structural alignment to proteins with annotated domains, or by comparison to Hidden Markov Models (HMMs) built based on documented domain sequences (e.g., Pfam HMM PF01844 for domain HNH).

As used herein, the term "base editor" generally refers to an enzyme that catalyzes the conversion of one target base or base pair into another (e.g. A:T to G:C, C:G to T:A) without requiring the creation and repair of a double-strand break. In some embodiments, the base editor is a deaminase.

As used herein, the term "deaminase" generally refers to a protein or enzyme that catalyzes a deamination reaction. In some embodiments, the deaminase is an adenosine deaminase, which catalyzes the hydrolytic deamination of adenine or adenosine (e.g., an engineered adenosine deaminase that deaminates adenosine in DNA). In some embodiments, the deaminase or deaminase domain is a cytidine (or cytosine) deaminase, catalyzing the hydrolytic deamination of cytidine (or cytosine) or deoxycytidine to uridine (or uracil) or deoxyuridine, respectively. In some embodiments, the deaminase or deaminase domain is a cytidine (or cytosine) deaminase domain, catalyzing the hydrolytic deamination of cytosine (or cytosine) to uracil (or uridine). In some embodiments, the deaminase or deaminase domain is a naturally-occurring deaminase from an organism, such as a human, chimpanzee, gorilla, monkey, cow, dog, rat, mouse, or bacterium (e.g. *E. coli*). In some embodiments, the deaminase or deaminase domain is a variant of a naturally-occurring deaminase from an organism that does not occur in nature.

The term "optimally aligned" in the context of two or more nucleic acids or polypeptide sequences, generally refers to two (e.g., in a pairwise alignment) or more (e.g., in a multiple sequence alignment) sequences that have been aligned to maximal correspondence of amino acids residues or nucleotides, for example, as determined by the alignment producing a highest or "optimized" percent identity score.

Included in the current disclosure are variants of any of the enzymes described herein with one or more conservative amino acid substitutions. Such conservative substitutions can be made in the amino acid sequence of a polypeptide without disrupting the three-dimensional structure or function of the polypeptide. Conservative substitutions can be accomplished by substituting amino acids with similar hydrophobicity, polarity, and R chain length for one another. Additionally, or alternatively, by comparing aligned sequences of homologous proteins from different species, conservative substitutions can be identified by locating amino acid residues that have been mutated between species (e.g., non-conserved residues) without altering the basic functions of the encoded proteins. Such conservatively substituted variants may include variants with at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of the endonuclease protein sequences described herein. In some embodiments, such conservatively substituted variants are functional variants. Such functional variants can encompass sequences with substitutions such that the activity of one or more critical active site residues or guide RNA binding residues of the endonuclease are not disrupted.

Also included in the current disclosure are variants of any of the enzymes described herein with substitution of one or more catalytic residues to decrease or eliminate activity of the enzyme (e.g. decreased-activity variants). In some embodiments, a decreased activity variant as a protein described herein comprises a disrupting substitution of at least one, at least two, or all three catalytic residues. In some embodiments, any of the endonucleases described herein can comprise a nickase mutation. In some embodiments, any of the endonucleases described herein can comprise a RuvC domain lacking nuclease activity. In some embodiments, any of the endonucleases described herein can be configured to cleave one strand of a double-stranded target deoxyribonucleic acid. In some embodiments, any of the endonucleases described herein can comprise can be configured to lack endonuclease activity or be catalytically dead.

Conservative substitution tables providing functionally similar amino acids are available from a variety of references (see, for e.g., Creighton, Proteins: Structures and Molecular Properties (W H Freeman & Co.; 2nd edition (December 1993)). The following eight groups each contain amino acids that are conservative substitutions for one another:

1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y), Tryptophan (W);
7) Serine (S), Threonine (T); and
8) Cysteine (C), Methionine (M)

Overview

The discovery of new CRISPR enzymes with unique functionality and structure may offer the potential to further disrupt deoxyribonucleic acid (DNA) editing technologies, improving speed, specificity, functionality, and ease of use. Relative to the predicted prevalence of Clustered Regularly Interspaced Short Palindromic Repeats (CRISPR) systems in microbes and the sheer diversity of microbial species, comparatively few functionally characterized CRISPR enzymes exist in the literature. This is partly because a huge number of microbial species may not be readily cultivated in laboratory conditions. Metagenomic sequencing from natural environmental niches that represent large numbers of microbial species may offer the potential to drastically increase the number of new CRISPR systems documented and speed the discovery of new oligonucleotide editing functionalities. A recent example of the fruitfulness of such an approach is demonstrated by the 2016 discovery of CasX/CasY CRISPR systems from metagenomic analysis of natural microbial communities.

CRISPR systems are RNA-directed nuclease complexes that have been described to function as an adaptive immune system in microbes. In their natural context, CRISPR systems occur in CRISPR (clustered regularly interspaced short palindromic repeats) operons or loci, which generally comprise two parts: (i) an array of short repetitive sequences (30-40 bp) separated by equally short spacer sequences, which encode the RNA-based targeting element; and (ii) ORFs encoding the nuclease polypeptide directed by the RNA-based targeting element alongside accessory proteins/enzymes. Efficient nuclease targeting of a particular target nucleic acid sequence generally requires both (i) complementary hybridization between the first 6-8 nucleic acids of the target (the target seed) and the crRNA guide; and (ii) the presence of a protospacer-adjacent motif (PAM) sequence within a defined vicinity of the target seed (the PAM usually being a sequence not commonly represented within the host genome). Depending on the exact function and organization of the system, CRISPR systems are commonly organized into 2 classes, 5 types and 16 subtypes based on shared functional characteristics and evolutionary similarity (see FIG. 1).

Class I CRISPR systems have large, multisubunit effector complexes, and comprise Types I, III, and IV.

Type I CRISPR systems are considered of moderate complexity in terms of components. In Type I CRISPR systems, the array of RNA-targeting elements is transcribed as a long precursor crRNA (pre-crRNA) that is processed at repeat elements to liberate short, mature crRNAs that direct the nuclease complex to nucleic acid targets when they are followed by a suitable short consensus sequence called a protospacer-adjacent motif (PAM). This processing occurs via an endoribonuclease subunit (Cas6) of a large endonuclease complex called Cascade, which also comprises a nuclease (Cas3) protein component of the crRNA-directed nuclease complex. Type I nucleases function primarily as DNA nucleases.

Type III CRISPR systems may be characterized by the presence of a central nuclease, known as Cas10, alongside a repeat-associated mysterious protein (RAMP) that comprises Csm or Cmr protein subunits. Like in Type I systems, the mature crRNA is processed from a pre-crRNA using a Cas6-like enzyme. Unlike type I and II systems, type III systems appear to target and cleave DNA-RNA duplexes (such as DNA strands being used as templates for an RNA polymerase).

Type IV CRISPR systems possess an effector complex that comprises a highly reduced large subunit nuclease (csf1), two genes for RAMP proteins of the Cas5 (csf3) and Cas7 (csf2) groups, and, in some cases, a gene for a predicted small subunit; such systems are commonly found on endogenous plasmids.

Class II CRISPR systems generally have single-polypeptide multidomain nuclease effectors, and comprise Types II, V and VI.

Type II CRISPR systems are considered the simplest in terms of components. In Type II CRISPR systems, the processing of the CRISPR array into mature crRNAs does not require the presence of a special endonuclease subunit, but rather a small trans-encoded crRNA (tracrRNA) with a region complementary to the array repeat sequence; the tracrRNA interacts with both its corresponding effector nuclease (e.g. Cas9) and the repeat sequence to form a precursor dsRNA structure, which is cleaved by endogenous RNAse III to generate a mature effector enzyme loaded with both tracrRNA and crRNA. Type II nucleases are known as DNA nucleases. Type 2 effectors generally exhibit a structure comprising a RuvC-like endonuclease domain that adopts the RNase H fold with an unrelated HNH nuclease domain inserted within the folds of the RuvC-like nuclease domain. The RuvC-like domain is responsible for the cleavage of the target (e.g., crRNA complementary) DNA strand, while the HNH domain is responsible for cleavage of the displaced DNA strand.

Type V CRISPR systems are characterized by a nuclease effector (e.g. Cas12) structure similar to that of Type II effectors, comprising a RuvC-like domain. Similar to Type II, most (but not all) Type V CRISPR systems use a tracrRNA to process pre-crRNAs into mature crRNAs; however, unlike Type II systems which requires RNAse III to cleave the pre-crRNA into multiple crRNAs, type V systems are capable of using the effector nuclease itself to cleave pre-crRNAs. Like Type-II CRISPR systems, Type V CRISPR systems are again known as DNA nucleases. Unlike Type II CRISPR systems, some Type V enzymes (e.g., Cas12a) appear to have a robust single-stranded nonspecific deoxyribonuclease activity that is activated by the first crRNA directed cleavage of a double-stranded target sequence.

Type VI CRISPR systems have RNA-guided RNA endonucleases. Instead of RuvC-like domains, the single polypeptide effector of Type VI systems (e.g. Cas13) comprises two HEPN ribonuclease domains. Differing from both Type II and V systems, Type VI systems also may not require a tracrRNA in some instances for processing of pre-crRNA into crRNA. Similar to type V systems, however, some Type VI systems (e.g., C2C2) appear to possess robust single-stranded nonspecific nuclease (ribonuclease) activity activated by the first crRNA directed cleavage of a target RNA.

Because of their simpler architecture, Class II CRISPR have been most widely adopted for engineering and development as designer nuclease/genome editing applications.

One of the early adaptations of such a system for in vitro use can be found in Jinek et al. (Science. 2012 Aug. 17; 337(6096):816-21, which is entirely incorporated herein by reference). The Jinek study first described a system that involved (i) recombinantly-expressed, purified full-length Cas9 (e.g., a Class II, Type II enzyme) isolated from *S. pyogenes* SF370, (ii) purified mature ~42 nt crRNA bearing a ~20 nt 5' sequence complementary to the target DNA sequence to be cleaved followed by a 3' tracr-binding sequence (the whole crRNA being in vitro transcribed from a synthetic DNA template carrying a T7 promoter sequence); (iii) purified tracrRNA in vitro transcribed from a synthetic DNA template carrying a T7 promoter sequence, and (iv) $Mg^{2+}$. Jinek later described an improved, engineered system wherein the crRNA of (ii) is joined to the 5' end of (iii) by a linker (e.g., GAAA) to form a single fused synthetic guide RNA (sgRNA) capable of directing Cas9 to a target by itself.

Mali et al. (Science. 2013 Feb. 15; 339(6121): 823-826.), which is entirely incorporated herein by reference, later adapted this system for use in mammalian cells by providing DNA vectors encoding (i) an ORF encoding codon-optimized Cas9 (e.g., a Class II, Type II enzyme) under a suitable mammalian promoter with a C-terminal nuclear localization sequence (e.g., SV40 NLS) and a suitable polyadenylation signal (e.g., TK pA signal); and (ii) an ORF encoding an sgRNA (having a 5' sequence beginning with G followed by 20 nt of a complementary targeting nucleic acid sequence joined to a 3' tracr-binding sequence, a linker, and the tracrRNA sequence) under a suitable Polymerase III promoter (e.g., the U6 promoter).

Base Editing

Base editing is the conversion of one target base or base pair into another (e.g. A:T to G:C, C:G to T:A) without requiring the creation and repair of a double-strand break. The base editing may be achieved with the help of DNA and RNA base editors that allow the introduction of point mutations at specific sites, in either DNA or RNA. Generally, DNA base editors may comprise a fusion of a catalytically inactive nuclease and a catalytically active base-modification enzyme that acts on single-stranded DNAs (ssDNAs). RNA base editors may comprise of similar, RNA-specific enzymes. Base editing may increase the efficiency of gene modification, while reducing the off-target and random mutations in the DNA.

DNA base editors are engineered ribonucleoprotein complexes that act as tools for single base substitution in cells and organism. They may be created by fusing an engineered base-modification enzyme and a catalytically deficient CRISPR endonuclease variant that cannot cut dsDNA, but it is able to unfold the dsDNA in a protospacer adjacent motif (PAM) sequence-dependent manner, such that a guide RNA can find its complementary target to indicate a ssDNA scission site. The guide RNA anneals to the complementary DNA, displacing a fragment of ssDNA and directing the CRISPR 'scissors' to the base modification site. The cellular repair machinery will repair the nicked non-edited strand using information from the complementary edited template.

So far, two types of DNA editors, cytosine base (CBEs) and adenine base editors (ABEs) have been developed. They were shown to efficiently and precisely edit point mutations in DNA with minimal off-target DNA editing (see Nat Biotechnol. 2017; 35:435-437, Nat Biotechnol. 2017; 35:438-440 and Nat Biotechnol. 2017; 35:475-480, each of which is entirely incorporated herein by reference). However, recent findings indicate that off-target modifications are present in DNA, and that many off-target modifications are also introduced into RNA by DNA base editors.

MG Base Editors

In some aspects, the present disclosure provides for an engineered nucleic acid editing system, comprising: (a) an endonuclease comprising a RuvC domain and an HNH domain, wherein the endonuclease is derived from an uncultivated microorganism, wherein the endonuclease is a class 2, type II endonuclease, and wherein the endonuclease is configured to be deficient in nuclease activity; (b) a base editor coupled to the endonuclease; and (c) an engineered guide ribonucleic acid structure configured to form a complex with the endonuclease comprising: (i) a guide ribonucleic acid sequence configured to hybridize to a target deoxyribonucleic acid sequence; and (ii) a ribonucleic acid sequence configured to bind to the endonuclease. In some embodiments, the endonuclease comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597, or a variant thereof. In some cases, the RuvC domain lacks nuclease activity. In some cases, the endonuclease comprises a nickase mutation. In some cases, the endonuclease is configured to cleave one strand of a double-stranded target deoxyribonucleic acid. In some cases the ribonucleic acid sequence configured to bind to the endonuclease comprises a tracr sequence.

In some aspects, the present disclosure provides for an engineered nucleic acid editing system comprising: (a) an endonuclease having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597, or a variant thereof, wherein the endonuclease is configured to be deficient in nuclease activity; a base editor coupled to the endonuclease; and an engineered guide ribonucleic acid structure configured to form a complex with the endonuclease comprising: (i) a guide ribonucleic acid sequence configured to hybridize to a target deoxyribonucleic acid sequence; and (ii) a ribonucleic acid sequence configured to bind to the endonuclease. In some cases the ribonucleic acid sequence configured to bind to the endonuclease comprises a tracr sequence. In some cases, the RuvC domain lacks nuclease activity. In some cases, the endonuclease comprises a nickase mutation. In some cases, the endonuclease is configured to cleave one strand of a double-stranded target deoxyribonucleic acid.

In some aspects, the present disclosure provides for an engineered nucleic acid editing system comprising: (a) an endonuclease configured to bind to a protospacer adjacent motif (PAM) sequence comprising any one of Sequence Numbers: A360-A368 or A598, wherein the endonuclease is a class 2, type II endonuclease, and the endonuclease is configured to be deficient in nuclease activity; and (b) a base editor coupled to the endonuclease; and (c) an engineered guide ribonucleic acid structure configured to form a complex with the endonuclease comprising: (i) a guide ribonucleic acid sequence configured to hybridize to a target deoxyribonucleic acid sequence; and (ii) a ribonucleic acid sequence configured to bind to the endonuclease. In some cases, the ribonucleic acid sequence configured to bind to the endonuclease comprises a tracr sequence. In some cases, the endonuclease comprises a nickase mutation. In some cases, the RuvC domain lacks nuclease activity. In some cases, the endonuclease is configured to cleave one strand of a double-stranded target deoxyribonucleic acid.

In some embodiments, the endonuclease is derived from an uncultivated microorganism. In some embodiments, the endonuclease has less than 80% identity to a Cas9 endonuclease. In some embodiments, the endonuclease further comprises an HNH domain. In some embodiments, the tracr ribonucleic acid sequence comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to about 60 to 90 consecutive nucleotides selected from any one of SEQ ID NOs: 88-96, 488-489, or 679-680, or a variant thereof. In some embodiments, the tracr ribonucleic acid sequence comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity non-degenerate nucleotides of any one of SEQ ID NOs: 88-96, 488-489, or 679-680, or a variant thereof.

In some aspects, the present disclosure provides an engineered nucleic acid editing system comprising, (a) an engineered guide ribonucleic acid structure comprising: (i) a guide ribonucleic acid sequence configured to hybridize to a target deoxyribonucleic acid sequence; and (ii) a tracr ribonucleic acid sequence configured to bind to an endonuclease, wherein the tracr ribonucleic acid sequence comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity non-degenerate nucleotides of any one of SEQ ID NOs: 88-96, 488-489, or 679-680, or a variant thereof; and a class 2, type II endonuclease configured to bind to the engineered guide ribonucleic acid.

In some embodiments, the endonuclease is configured to bind to a protospacer adjacent motif (PAM) sequence comprising any one of Sequence Numbers: A360, A362, or A368. In some embodiments, the base editor comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 1-51, 57-66, 385-443, 444-475, 594-595, or 599-675, or a variant thereof. In some embodiments, the base editor is an adenine deaminase. In some embodiments, the adenosine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NOs: 50-51, 57, 385-443, 448-475, or 595, or a variant thereof. In some embodiments, the base editor is a cytidine deaminase. In some embodiments, the cytidine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 1-49, 444-447, 594, or 58-66, or a variant thereof.

In some embodiments, the engineered nucleic acid editing system further comprises a uracil DNA glycosylase inhibitor. In some embodiments, the uracil DNA glycosylase inhibitor comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 52-56 or SEQ ID NO: 67, or a variant thereof.

In some embodiments, the engineered guide ribonucleic acid structure comprises at least two ribonucleic acid polynucleotides. In some embodiments, the engineered guide ribonucleic acid structure comprises one ribonucleic acid polynucleotide comprising the guide ribonucleic acid sequence and the tracr ribonucleic acid sequence. In some embodiments, the guide ribonucleic acid sequence is complementary to a prokaryotic, bacterial, archaeal, eukaryotic, fungal, plant, mammalian, or human genomic sequence. In some embodiments, the guide ribonucleic acid sequence is 15-24 nucleotides in length. In some embodiments, the endonuclease comprises one or more nuclear localization sequences (NLSs) proximal to an N- or C-terminus of the endonuclease.

The NLS can comprise any of the sequences in Table 1 below, or a combination thereof:

TABLE 1

Example NLS Sequences that can be used with Effectors According to the Disclosure

| Source | NLS amino acid sequence | SEQ ID NO: |
|---|---|---|
| SV40 | PKKKRKV | 369 |
| nucleoplasmin bipartite NLS | KRPAATKKAGQAKKKK | 370 |

TABLE 1-continued

Example NLS Sequences that can be used with Effectors According to the Disclosure

| Source | NLS amino acid sequence | SEQ ID NO: |
|---|---|---|
| c-myc NLS | PAAKRVKLD | 371 |
| c-myc NLS | RQRRNELKRSP | 372 |
| hRNPA1 M9 NLS | NQSSNFGPMKGGNFGGRSSGPYGGGGQYFAKPRNQGGY | 373 |
| Importin-alpha IBB domain | RMRIZFKNKGKDTAELRRRRVEVSVELRKAKKDEQILKRRNV | 374 |
| Myoma T protein | VSRKRPRP | 375 |
| Myoma T protein | PPKKARED | 376 |
| p53 | PQPKKKPL | 377 |
| mouse c-abl IV | SALIKKKKKMAP | 378 |
| influenza virus NS1 | DRLRR | 379 |
| influenza virus NS1 | PKQKKRK | 380 |
| Hepatitis virus delta antigen | RKLKKKIKKL | 381 |
| mouse Mx1 protein | REKKKFLKRR | 382 |
| human poly (ADP-ribose) polymerase | KRKGDEVDGVDEVAKKKSKK | 383 |
| steroid hormone receptor (human) glucocorticoid | RKCLQAGMNLEARKTKK | 384 |

In some embodiments, the endonuclease is covalently coupled directly to the base editor or covalently coupled to the base editor through a linker. In some embodiments, linkers joining any of the enzymes or domains described herein can comprise one or multiple copies of a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SGGSSGGSSGSETPGTSESATPESSGGSSGGS (SEQ ID NO: 592), SGSETPGTSESATPESA (SEQ ID NO: 591), GSGGS (SEQ ID NO: 1870), SGSETPGTSESATPES (SEQ ID NO: 590), SGGSS (SEQ ID NO: 1871), or GAAA (SEQ ID NO: 1872), or any other linker sequence described herein. In some embodiments, a polypeptide comprises the endonuclease and the base editor. In some embodiments, the endonuclease is configured to cleave one strand of a double-stranded target deoxyribonucleic acid. In some embodiments, the endonuclease comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597, or a variant thereof. In some embodiments, the system further comprises a source of $Mg^{2+}$.

In some embodiments, the endonuclease comprises a sequence at least 70%, at least 80%, or at least 90% identical to SEQ ID NO: 70, or a variant thereof; the guide RNA structure comprises a sequence at least 70%, at least 80%, or at least 90% identical to at least one of SEQ ID NO: 88; and the endonuclease is configured to bind to a PAM comprising Sequence Number: A360.

In some embodiments, the endonuclease comprises a sequence at least 70%, at least 80%, or at least 90% identical to SEQ ID NO: 71, or a variant thereof; the guide RNA structure comprises a sequence at least 70%, at least 80%, or at least 90% identical to at least one of SEQ ID NO: 89; and the endonuclease is configured to bind to a PAM comprising Sequence Number: A361.

In some embodiments, the endonuclease comprises a sequence at least 70%, at least 80%, or at least 90% identical to SEQ ID NO: 73, or a variant thereof; the guide RNA structure comprises a sequence at least 70%, at least 80%, or at least 90% identical to at least one of SEQ ID NO: 91; and the endonuclease is configured to bind to a PAM comprising Sequence Number: A363.

In some embodiments, the endonuclease comprises a sequence at least 70%, at least 80%, or at least 90% identical to SEQ ID NO: 75, or a variant thereof; the guide RNA structure comprises a sequence at least 70%, at least 80%, or at least 90% identical to at least one of SEQ ID NO: 93; and the endonuclease is configured to bind to a PAM comprising Sequence Number: A365.

In some embodiments, the endonuclease comprises a sequence at least 70%, at least 80%, or at least 90% identical to SEQ ID NO: 76, or a variant thereof; the guide RNA structure comprises a sequence at least 70%, at least 80%, or at least 90% identical to at least one of SEQ ID NO: 94; and the endonuclease is configured to bind to a PAM comprising Sequence Number: A366.

In some embodiments, the endonuclease comprises a sequence at least 70%, at least 80%, or at least 90% identical to SEQ ID NO: 77, or a variant thereof; the guide RNA structure comprises a sequence at least 70%, at least 80%, or at least 90% identical to at least one of SEQ ID NO: 95; and the endonuclease is configured to bind to a PAM comprising Sequence Number: A367.

In some embodiments, the endonuclease comprises a sequence at least 70%, at least 80%, or at least 90% identical to SEQ ID NO: 78, or a variant thereof; the guide RNA structure comprises a sequence at least 70%, at least 80%, or at least 90% identical to at least one of SEQ ID NO: 96; and the endonuclease is configured to bind to a PAM comprising Sequence Number: A368.

In some embodiments, the base editor comprises an adenine deaminase. In some embodiments, the adenine deaminase comprises SEQ ID NO: 57, or a variant thereof. In some embodiments, the base editor comprises a cytidine deaminase. In some embodiments, the cytidine deaminase comprises SEQ ID NO: 58, or a variant thereof. In some embodiments, the engineered nucleic acid editing system described herein further comprises a uracil DNA glycosylation inhibitor. In some embodiments, the uracil DNA glycosylation inhibitor comprises SEQ ID NO: 67, or a variant thereof.

In some embodiments, the sequence identity is determined by a BLASTP, CLUSTALW, MUSCLE, MAFFT, or Smith-Waterman homology search algorithm. In some embodiments, the sequence identity is determined by said BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment.

In some aspects, the present disclosure provides a nucleic acid comprising an engineered nucleic acid sequence optimized for expression in an organism, wherein the nucleic acid encodes a class 2, type II endonuclease coupled to a base editor, and wherein the endonuclease is derived from an uncultivated microorganism.

In some aspects, the present disclosure provides a nucleic acid comprising an engineered nucleic acid sequence optimized for expression in an organism, wherein the nucleic acid encodes an endonuclease having at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597, or a variant thereof coupled to a base editor. In some embodiments, the endonuclease comprises a sequence encoding one or more nuclear localization sequences (NLSs) proximal to an N- or C-terminus of said endonuclease. In some embodiments, the organism is prokaryotic, bacterial, eukaryotic, fungal, plant, mammalian, rodent, or human.

In some aspects, the present disclosure provides a vector comprising a nucleic acid sequence encoding a class 2, type II endonuclease coupled to a base editor, wherein said endonuclease is derived from an uncultivated microorganism. In some embodiments, the vector comprises the nucleic acid described herein. In some embodiments, the vector further comprises a nucleic acid encoding an engineered guide ribonucleic acid structure configured to form a complex with the endonuclease comprising: a guide ribonucleic acid sequence configured to hybridize to a target deoxyribonucleic acid sequence; and a tracr ribonucleic acid sequence configured to binding to the endonuclease. In some embodiments, the vector is a plasmid, a minicircle, a CELiD, an adeno-associated virus (AAV) derived virion, or a lentivirus. In some aspects, the present disclosure provides a cell comprising the vector described herein. In some aspects, the present disclosure provides a method of manufacturing an endonuclease, comprising cultivating the cell described herein.

In some aspects, the present disclosure provides a method for modifying a double-stranded deoxyribonucleic acid polynucleotide comprising contacting the double-stranded deoxyribonucleic acid polynucleotide with a complex comprising: an endonuclease comprising a RuvC domain and an HNH domain, wherein the endonuclease is derived from an uncultivated microorganism, wherein the endonuclease is a class 2, type II endonuclease, and wherein the RuvC domain lacks nuclease activity; a base editor coupled to the endonuclease; and an engineered guide ribonucleic acid structure configured to bind to the endonuclease and the double-stranded deoxyribonucleic acid polynucleotide; wherein the double-stranded deoxyribonucleic acid polynucleotide comprises a protospacer adjacent motif (PAM).

In some embodiments, the endonuclease comprising a RuvC domain and an HNH domain is covalently coupled directly to the base editor or covalently coupled to the base editor through a linker. In some embodiments, the endonuclease comprising a RuvC domain and an HNH domain comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597, or a variant thereof.

In some aspects, the present disclosure provides a method for modifying a double-stranded deoxyribonucleic acid polynucleotide, comprising contacting the double-stranded deoxyribonucleic acid polynucleotide with a complex comprising: a class 2, type II endonuclease, a base editor coupled to the endonuclease, and an engineered guide ribonucleic acid structure configured to bind to the endonuclease and the double-stranded deoxyribonucleic acid polynucleotide; wherein the double-stranded deoxyribonucleic acid polynucleotide comprises a protospacer adjacent motif (PAM); and wherein the PAM comprises a sequence selected from the group consisting of Sequence Numbers: A360-A368 or A598, or a variant thereof.

In some embodiments, the class 2, type II endonuclease is covalently coupled to the base editor or coupled to the base editor through a linker. In some embodiments, the base editor comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from SEQ ID NOs: 1-51, 57-66, 385-443, 444-475, 594-595, or 599-675, or a variant thereof. In some embodiments, the base editor comprises an adenine deaminase; the double-stranded deoxyribonucleic acid polynucleotide comprises an adenine; and modifying the double-stranded deoxyribonucleic acid polypeptide comprises converting the adenine to guanine. In some embodiments, the adenine deaminase comprises a sequence with at least 95% identity to SEQ ID NO: 57, or a variant thereof.

In some embodiments, the base editor comprises a cytidine deaminase; the double-stranded deoxyribonucleic acid polynucleotide comprises a cytosine; and modifying the double-stranded deoxyribonucleic acid polypeptide comprises converting the cytosine to uracil. In some embodiments, the cytidine deaminase comprises a sequence with at least 95% identity to SEQ ID NO: 58, or a variant thereof.

In some embodiments, the cytidine deaminase comprises a sequence with at least 95% identity to any one of SEQ ID NOs: 59-66, or a variant thereof.

In some embodiments, the complex further comprises a uracil DNA glycosylase inhibitor. In some embodiments, the uracil DNA glycosylase inhibitor comprises a sequence with at least 70%, 80%, 90% or 95% identity to any one of SEQ ID NOs: 52-56 or SEQ ID NO: 67, or a variant thereof. In some embodiments, the double-stranded deoxyribonucleic acid polynucleotide comprises a first strand comprising a sequence complementary to a sequence of the engineered guide ribonucleic acid structure and a second strand comprising said PAM. In some embodiments, the PAM is directly adjacent to the 3' end of the sequence complementary to the sequence of the engineered guide ribonucleic acid structure.

In some embodiments, the class 2, type II endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, the class 2, type II endonuclease is derived from an uncultivated microorganism. In some embodiments, the double-stranded deoxyribonucleic acid polynucleotide is a eukaryotic, plant, fungal, mammalian, rodent, or human double-stranded deoxyribonucleic acid polynucleotide.

In some aspects, the present disclosure provides a method of modifying a target nucleic acid locus, said method comprising delivering to said target nucleic acid locus the engineered nucleic acid editing system described herein, wherein the endonuclease is configured to form a complex with the engineered guide ribonucleic acid structure, and wherein the complex is configured such that upon binding of the complex to the target nucleic acid locus, the complex modifies a nucleotide of the target nucleic locus.

In some embodiments, the engineered nucleic acid editing system comprises an adenine deaminase, the nucleotide is an adenine, and modifying the target nucleic acid locus comprises converting the adenine to a guanine. In some embodiments, the engineered nucleic acid editing system comprises a cytidine deaminase and a uracil DNA glycosylase inhibitor, the nucleotide is a cytosine and modifying the target nucleic acid locus comprises converting the adenine to a uracil. In some embodiments, the target nucleic acid locus comprises genomic DNA, viral DNA, or bacterial DNA. In some embodiments, the target nucleic acid locus is in vitro. In some embodiments, the target nucleic acid locus is within a cell. In some embodiments, the cell is a prokaryotic cell, a bacterial cell, a eukaryotic cell, a fungal cell, a plant cell, an animal cell, a mammalian cell, a rodent cell, a primate cell, or a human cell. In some embodiments, the cell is within an animal.

In some embodiments, the cell is within a cochlea. In some embodiments, the cell is within an embryo. In some embodiments, the embryo is a two-cell embryo. In some embodiments, the embryo is a mouse embryo. In some embodiments, delivering the engineered nucleic acid editing system to the target nucleic acid locus comprises delivering the nucleic acid described herein or the vector described herein. In some embodiments, delivering the engineered nucleic acid editing system to the target nucleic acid locus comprises delivering a nucleic acid comprising an open reading frame encoding the endonuclease.

In some embodiments, the nucleic acid comprises a promoter to which the open reading frame encoding the endonuclease is operably linked. In some embodiments, delivering the engineered nucleic acid editing system to said target nucleic acid locus comprises delivering a capped mRNA containing the open reading frame encoding the endonuclease. In some embodiments, delivering the engineered nucleic acid editing system to the target nucleic acid locus comprises delivering a translated polypeptide. In some embodiments, delivering the engineered nucleic acid editing system to the target nucleic acid locus comprises delivering a deoxyribonucleic acid (DNA) encoding the engineered guide ribonucleic acid structure operably linked to a ribonucleic acid (RNA) pol III promoter.

In some aspects, the present disclosure provides an engineered nucleic acid editing polypeptide, comprising: an endonuclease comprising a RuvC domain and an HNH domain, wherein the endonuclease is derived from an uncultivated microorganism, wherein the endonuclease is a class 2, type II endonuclease, and wherein the endonuclease is configured to be deficient in nuclease activity. In some embodiments, the endonuclease comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597, or a variant thereof.

In some aspects, the present disclosure provides an engineered nucleic acid editing polypeptide, comprising: an endonuclease having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597, or a variant thereof, wherein the endonuclease is configured to be deficient in nuclease activity; and a base editor coupled to the endonuclease.

In some aspects, the present disclosure provides an engineered nucleic acid editing polypeptide, comprising: an endonuclease configured to bind to a protospacer adjacent motif (PAM) sequence comprising any one of Sequence Numbers: A360-A368 or A598, wherein the endonuclease is a class 2, type II endonuclease, and wherein the endonuclease is configured to be deficient in nuclease activity; and a base editor coupled to the endonuclease.

In some embodiments, the endonuclease is derived from an uncultivated microorganism. In some embodiments, the endonuclease has less than 80% identity to a Cas9 endonuclease. In some embodiments, the endonuclease further comprises an HNH domain. In some embodiments, the ribonucleic acid sequence configured to bind the endonuclease comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to about 60 to 90 consecutive nucleotides selected from any one of SEQ ID NOs: 88-96, 488-489, or 679-680, or a variant thereof. In some embodiments, the ribonucleic acid sequence configured to bind the endonuclease comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to non-degenerate nucleotides of any one of SEQ ID NOs: 88-96, 488-489, or 679-680, or a variant thereof. In some embodiments, the base editor comprises a sequence with at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597, or a variant thereof. In some embodiments, the base editor is an adenine deaminase. In some embodiments, the adenosine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 50-51, 57, 385-443, 448-475, or 595, or a variant thereof. In some embodiments, the base editor is a cytidine deaminase. In some embodiments, the cytidine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 1-49, 444-447, 594, or 58-66, or a variant thereof.

Systems of the present disclosure may be used for various applications, such as, for example, nucleic acid editing (e.g., gene editing), binding to a nucleic acid molecule (e.g., sequence-specific binding). Such systems may be used, for example, for addressing (e.g., removing or replacing) a genetically inherited mutation that may cause a disease in a subject, inactivating a gene in order to ascertain its function in a cell, as a diagnostic tool to detect disease-causing genetic elements (e.g. via cleavage of reverse-transcribed viral RNA or an amplified DNA sequence encoding a disease-causing mutation), as deactivated enzymes in combination with a probe to target and detect a specific nucleotide sequence (e.g. sequence encoding antibiotic resistance int bacteria), to render viruses inactive or incapable of infecting host cells by targeting viral genomes, to add genes or amend metabolic pathways to engineer organisms to produce valuable small molecules, macromolecules, or secondary metabolites, to establish a gene drive element for evolutionary selection, to detect cell perturbations by foreign small molecules and nucleotides as a biosensor.

TABLE 2

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG66 putative cytidine deaminase | | 1 | MG66-2 deaminase | protein | unknown | uncultivated organism |
| MG66 putative cytidine deaminase | | 2 | MG66-3 deaminase | protein | unknown | uncultivated organism |
| MG66 putative cytidine deaminase | | 3 | MG66-4 deaminase | protein | unknown | uncultivated organism |
| MG66 putative cytidine deaminase | | 4 | MG66-5 deaminase | protein | unknown | uncultivated organism |
| MG66 putative cytidine deaminase | | 5 | MG66-6 deaminase | protein | unknown | uncultivated organism |
| MG66 putative cytidine deaminase | | 6 | MG66-7 deaminase | protein | unknown | uncultivated organism |
| MG66 putative cytidine deaminase | | 7 | MG66-8 deaminase | protein | unknown | uncultivated organism |
| MG66 putative cytidine deaminase | | 8 | MG66-9 deaminase | protein | unknown | uncultivated organism |
| MG66 putative cytidine deaminase | | 9 | MG66-10 deaminase | protein | unknown | uncultivated organism |
| MG66 putative cytidine deaminase | | 10 | MG66-11 deaminase | protein | unknown | uncultivated organism |
| MG66 putative cytidine deaminase | | 11 | MG66-12 deaminase | protein | unknown | uncultivated organism |

TABLE 2-continued

| Category | Sequence Number | SEQ ID NO: | Description | Type | Organism | Other Information or Sequence |
|---|---|---|---|---|---|---|
| Sequence Listing of Protein and Nucleic Acid Sequences Referred to Herein | | | | | | |
| MG66 putative cytidine deaminase | | 12 | MG66-13 deaminase | protein | unknown | uncultivated organism |
| MG66 putative cytidine deaminase | | 13 | MG66-14 deaminase | protein | unknown | uncultivated organism |
| MG66 putative cytidine deaminase | | 14 | MG66-15 deaminase | protein | unknown | uncultivated organism |
| MG66 putative cytidine deaminase | | 15 | MG66-18 deaminase | protein | unknown | uncultivated organism |
| MG66 putative cytidine deaminase | | 16 | MG66-19 deaminase | protein | unknown | uncultivated organism |
| MG66 putative cytidine deaminase | | 17 | MG66-20 deaminase | protein | unknown | uncultivated organism |
| MG66 putative cytidine deaminase | | 18 | MG66-21 deaminase | protein | unknown | uncultivated organism |
| MG66 putative cytidine deaminase | | 19 | MG66-22 deaminase | protein | unknown | uncultivated organism |
| MG66 putative cytidine deaminase | | 20 | MG66-23 deaminase | protein | unknown | uncultivated organism |
| MG66 putative cytidine deaminase | | 21 | MG66-24 deaminase | protein | unknown | uncultivated organism |
| MG66 putative cytidine deaminase | | 22 | MG66-25 deaminase | protein | unknown | uncultivated organism |
| MG66 putative cytidine deaminase | | 23 | MG66-26 deaminase | protein | unknown | uncultivated organism |
| MG66 putative cytidine deaminase | | 24 | MG66-27 deaminase | protein | unknown | uncultivated organism |
| MG66 putative cytidine deaminase | | 25 | MG66-28 deaminase | protein | unknown | uncultivated organism |
| MG66 putative cytidine deaminase | | 26 | MG66-29 deaminase | protein | unknown | uncultivated organism |
| MG66 putative cytidine deaminase | | 27 | MG66-30 deaminase | protein | unknown | uncultivated organism |
| MG66 putative cytidine deaminase | | 28 | MG66-31 deaminase | protein | unknown | uncultivated organism |
| MG66 putative cytidine deaminase | | 29 | MG66-32 deaminase | protein | unknown | uncultivated organism |

TABLE 2-continued

| Category | Sequence Number | SEQ ID NO: | Description | Type | Organism | Other Information or Sequence |
|---|---|---|---|---|---|---|
| Sequence Listing of Protein and Nucleic Acid Sequences Referred to Herein | | | | | | |
| MG66 putative cytidine deaminase | | 30 | MG66-33 deaminase | protein | unknown | uncultivated organism |
| MG66 putative cytidine deaminase | | 31 | MG66-34 deaminase | protein | unknown | uncultivated organism |
| MG66 putative cytidine deaminase | | 32 | MG66-35 deaminase | protein | unknown | uncultivated organism |
| MG66 putative cytidine deaminase | | 33 | MG66-36 deaminase | protein | unknown | uncultivated organism |
| MG66 putative cytidine deaminase | | 34 | MG66-37 deaminase | protein | unknown | uncultivated organism |
| MG66 putative cytidine deaminase | | 35 | MG66-38 deaminase | protein | unknown | uncultivated organism |
| MG66 putative cytidine deaminase | | 36 | MG66-39 deaminase | protein | unknown | uncultivated organism |
| MG66 putative cytidine deaminase | | 37 | MG66-40 deaminase | protein | unknown | uncultivated organism |
| MG66 putative cytidine deaminase | | 38 | MG66-41 deaminase | protein | unknown | uncultivated organism |
| MG66 putative cytidine deaminase | | 39 | MG66-42 deaminase | protein | unknown | uncultivated organism |
| MG66 putative cytidine deaminase | | 40 | MG66-43 deaminase | protein | unknown | uncultivated organism |
| MG66 putative cytidine deaminase | | 41 | MG66-44 deaminase | protein | unknown | uncultivated organism |
| MG66 putative cytidine deaminase | | 42 | MG66-45 deaminase | protein | unknown | uncultivated organism |
| MG66 putative cytidine deaminase | | 43 | MG66-46 deaminase | protein | unknown | uncultivated organism |
| MG66 putative cytidine deaminase | | 44 | MG66-47 deaminase | protein | unknown | uncultivated organism |
| MG66 putative cytidine deaminase | | 45 | MG66-48 deaminase | protein | unknown | uncultivated organism |
| MG66 putative cytidine deaminase | | 46 | MG66-49 deaminase | protein | unknown | uncultivated organism |
| MG66 putative cytidine deaminase | | 47 | MG66-50 deaminase | protein | unknown | uncultivated organism |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG67 putative cytidine deaminase | | 48 | MG67-2 deaminase | protein | unknown | uncultivated organism |
| MG67 putative cytdidine deaminase | | 49 | MG67-4 deaminase | protein | unknown | uncultivated organism |
| MG68 putative adenosine deaminase (TadA-like) | | 50 | MG68-1 deaminase | protein | unknown | uncultivated organism |
| MG68 putative adenosine deaminase (TadA-like) | | 51 | MG68-2 deaminase | protein | unknown | uncultivated organism |
| MG69 UGI | | 52 | MG69-1 deaminase | protein | unknown | uncultivated organism |
| MG69 UGI | | 53 | MG69-2 deaminase | protein | unknown | uncultivated organism |
| MG69 UGI | | 54 | MG69-3 deaminase | protein | unknown | uncultivated organism |
| MG69 UGI | | 55 | MG69-4 deaminase | protein | unknown | uncultivated organism |
| MG69 UGI | | 56 | MG69-5 deaminase | protein | unknown | uncultivated organism |
| reference deaminase | | 57 | P68398 TADA tRNA specific adenosine deaminase | protein | *Escherichia coli* strain K12 OX | |
| reference deaminase | | 58 | P38483 APOBEC 1 C U editing deaminase | protein | *Rattus norvegicus* | |
| reference deaminase | | 59 | Aicda XM 004869540 cytidine deaminase | protein | *Heterocephalus glaber* | |
| reference deaminase | | 60 | PmCDA1 L1 AVN88313.1 cytidine deaminase | protein | *Petromyzo marinus* | |
| reference deaminase | | 61 | PmCDA1 ABO15149.1 cytosine deaminase | protein | *Petromyzo marinus* | |
| reference deaminase | | 62 | NP 663745.1 DNA dC- dU-editing deaminase APOBEC-3A isoform a | protein | *Homo sapien* S | |
| reference deaminase | | 63 | Q9GZX7.1 AICDA Single-stranded DNA cytosine deaminase (Activation-induced cytidine deaminase, Cytidine aminohydrolase) | protein | *Homo sapien* S | |
| reference deaminase | | 64 | LpCDA1L1 3 AVN88320.1 cytidine deaminase | protein | *Lampetra planeri* | |
| reference deaminase | | 65 | LpCDA1L1 1 AVN88319.1 cytidine deaminase | protein | *Lampetra planeri* | |
| reference deaminase | | 66 | ljCDA1 cytidine deaminase | nucleotide | *Lampetra planeri* | |
| reference UGI | | 67 | P14739 UNGI BPPB2 (UGI) | protein | Bacillus phage PBS2 | |
| adenine base editor | | 68 | linker-His tag-adenine deaminse-linker-nickase-linker-SV40 NLS | protein | artificial sequence | |
| cytosine base editor | | 69 | linker-His tag-cytidine deaminase-linker-nickase-linker-uracil glycosylase inhibitor-linker-SV40 NLS | protein | artificial sequence | |
| nickase | | 70 | nMG1-4 (D9A) nickase | protein | artificial sequence | |
| nickase | | 71 | nMG1-6 (D13A) nickase | protein | artificial sequence | |
| nickase | | 72 | nMG3-6 (D13A) nickase | protein | artificial sequence | |
| nickase | | 73 | nMG3-7 (D12A) nickase | protein | artificial sequence | |
| nickase | | 74 | nMG3-8 (D13A) nickase | protein | artificial sequence | |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| nickase | | 75 | nMG4-5 (D17A) nickase | protein | artificial sequence | |
| nickase | | 76 | nMG14-1 (D23A) nickase | protein | artificial sequence | |
| nickase | | 77 | nMG15-1 (D8A) nickase | protein | artificial sequence | |
| nickase | | 78 | nMG18-1 (D12A) nickase | protein | artificial sequence | |
| target sequence | | 79 | nMG1-4 (D9A) protospacer and PAM for in vitro nickase assay | nucleotide | artificial sequence | |
| target sequence | | 80 | nMG1-6 (D13A) protospacer and PAM for in vitro nickase assay | nucleotide | artificial sequence | |
| target sequence | | 81 | nMG3-6 (D13A) protospacer and PAM for in vitro nickase assay | nucleotide | artificial sequence | |
| target sequence | | 82 | nMG3-7 (D12A) protospacer and PAM for in vitro nickase assay | nucleotide | artificial sequence | |
| target sequence | | 83 | nMG3-8 (D13A) protospacer and PAM for in vitro nickase assay | nucleotide | artificial sequence | |
| target sequence | | 84 | nMG4-5 (D17A) protospacer and PAM for in vitro nickase assay | nucleotide | artificial sequence | |
| target sequence | | 85 | nMG14-1 (D23A) protospacer and PAM for in vitro nickase assay | nucleotide | artificial sequence | |
| target sequence | | 86 | nMG15-1 (D8A) protospacer and PAM for in vitro nickase assay | nucleotide | artificial sequence | |
| target sequence | | 87 | nMG18-1 (D12A) protospacer and PAM for in vitro nickase assay | nucleotide | artificial sequence | |
| single guide RNA | | 88 | nMG1-4 (D9A) single guide RNA for in vitro nickase assay | nucleotide | artificial sequence | |
| single guide RNA | | 89 | nMG1-6 (D13A) single guide RNA for in vitro nickase assay | nucleotide | artificial sequence | |
| single guide RNA | | 90 | nMG3-6 (D13A) single guide RNA for in vitro nickase assay | nucleotide | artificial sequence | |
| single guide RNA | | 91 | nMG3-7 (D12A) single guide RNA for in vitro nickase assay | nucleotide | artificial sequence | |
| single guide RNA | | 92 | nMG3-8 (D13A) single guide RNA for in vitro nickase assay | nucleotide | artificial sequence | |
| single guide RNA | | 93 | nMG4-5 (D17A) single guide RNA for in vitro nickase assay | nucleotide | artificial sequence | |
| single guide RNA | | 94 | nMG14-1 (D23A) single guide RNA for in vitro nickase assay | nucleotide | artificial sequence | |
| single guide RNA | | 95 | nMG15-1 (D8A) single guide RNA for in vitro nickase assay | nucleotide | artificial sequence | |
| single guide RNA | | 96 | nMG18-1 (D12A) single guide RNA for in vitro nickase assay | nucleotide | artificial sequence | |
| spacer | | 97 | MGA1-4 sgRNA spacer 1 (targeting *E. coli* lacZ) | nucleotide | artificial sequence | |
| spacer | | 98 | MGA1-4 sgRNA spacer 2 (targeting *E. coli* lacZ) | nucleotide | artificial sequence | |
| spacer | | 99 | MGA1-4 sgRNA spacer 3 (targeting *E. coli* lacZ) | nucleotide | artificial sequence | |
| spacer | | 100 | MGA1-6 sgRNA spacer 1 (targeting *E. coli* lacZ) | nucleotide | artificial sequence | |
| spacer | | 101 | MGA1-6 sgRNA spacer 2 (targeting *E. coli* lacZ) | nucleotide | artificial sequence | |
| spacer | | 102 | MGA1-6 sgRNA spacer 3 (targeting *E. coli* lacZ) | nucleotide | artificial sequence | |
| spacer | | 103 | MGA3-6 sgRNA spacer 1 (targeting *E. coli* lacZ) | nucleotide | artificial sequence | |
| spacer | | 104 | MGA3-6 sgRNA spacer 2 (targeting *E. coli* lacZ) | nucleotide | artificial sequence | |
| spacer | | 105 | MGA3-6 sgRNA spacer 3 (targeting *E. coli* lacZ) | nucleotide | artificial sequence | |
| spacer | | 106 | MGA3-7 sgRNA spacer 1 (targeting *E. coli* lacZ) | nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| spacer | | 107 | MGA3-7 sgRNA spacer 2 (targeting *E. coli* lacZ) | nucleotide | artificial sequence | |
| spacer | | 108 | MGA3-7 sgRNA spacer 3 (targeting *E. coli* lacZ) | nucleotide | artificial sequence | |
| spacer | | 109 | MGA3-8 sgRNA spacer 1 (targeting *E. coli* lacZ) | nucleotide | artificial sequence | |
| spacer | | 110 | MGA3-8 sgRNA spacer 2 (targeting *E. coli* lacZ) | nucleotide | artificial sequence | |
| spacer | | 111 | MGA3-8 sgRNA spacer 3 (targeting *E. coli* lacZ) | nucleotide | artificial sequence | |
| spacer | | 112 | MGA4-5 sgRNA spacer 1 (targeting *E. coli* lacZ) | nucleotide | artificial sequence | |
| spacer | | 113 | MGA4-5 sgRNA spacer 2 (targeting *E. coli* lacZ) | nucleotide | artificial sequence | |
| spacer | | 114 | MGA4-5 sgRNA spacer 3 (targeting *E. coli* lacZ) | nucleotide | artificial sequence | |
| spacer | | 115 | MGA14-1 sgRNA spacer 1 (targeting *E. coli* lacZ) | nucleotide | artificial sequence | |
| spacer | | 116 | MGA14-1 sgRNA spacer 2 (targeting *E. coli* lacZ) | nucleotide | artificial sequence | |
| spacer | | 117 | MGA14-1 sgRNA spacer 3 (targeting *E. coli* lacZ) | nucleotide | artificial sequence | |
| spacer | | 118 | MGA15-1 sgRNA spacer 1 (targeting *E. coli* lacZ) | nucleotide | artificial sequence | |
| spacer | | 119 | MGA15-1 sgRNA spacer 2 (targeting *E. coli* lacZ) | nucleotide | artificial sequence | |
| spacer | | 120 | MGA15-1 sgRNA spacer 3 (targeting *E. coli* lacZ) | nucleotide | artificial sequence | |
| spacer | | 121 | MGA18-1 sgRNA spacer 1 (targeting *E. coli* lacZ) | nucleotide | artificial sequence | |
| spacer | | 122 | MGA18-1 sgRNA spacer 2 (targeting *E. coli* lacZ) | nucleotide | artificial sequence | |
| spacer | | 123 | MGA18-1 sgRNA spacer 3 (targeting *E. coli* lacZ) | nucleotide | artificial sequence | |
| spacer | | 124 | ABE8.17m sgRNA spacer 1 (targeting *E. coli* lacZ) | nucleotide | artificial sequence | |
| spacer | | 125 | ABE8.17m sgRNA spacer 2 (targeting *E. coli* lacZ) | nucleotide | artificial sequence | |
| spacer | | 126 | ABE8.17m sgRNA spacer 3 (targeting *E. coli* lacZ) | nucleotide | artificial sequence | |
| spacer | | 127 | MGC1-4 sgRNA spacer 1 (targeting *E. coli* lacZ) | nucleotide | artificial sequence | |
| spacer | | 128 | MGC1-4 sgRNA spacer 2 (targeting *E. coli* lacZ) | nucleotide | artificial sequence | |
| spacer | | 129 | MGC1-4 sgRNA spacer 3 (targeting *E. coli* lacZ) | nucleotide | artificial sequence | |
| spacer | | 130 | MGC1-6 sgRNA spacer 1 (targeting *E. coli* lacZ) | nucleotide | artificial sequence | |
| spacer | | 131 | MGC1-6 sgRNA spacer 2 (targeting *E. coli* lacZ) | nucleotide | artificial sequence | |
| spacer | | 132 | MGC1-6 sgRNA spacer 3 (targeting *E. coli* lacZ) | nucleotide | artificial sequence | |
| spacer | | 133 | MGC3-6 sgRNA spacer 1 (targeting *E. coli* lacZ) | nucleotide | artificial sequence | |
| spacer | | 134 | MGC3-6 sgRNA spacer 2 (targeting *E. coli* lacZ) | nucleotide | artificial sequence | |
| spacer | | 135 | MGC3-6 sgRNA spacer 3 (targeting *E. coli* lacZ) | nucleotide | artificial sequence | |
| spacer | | 136 | MGC3-7 sgRNA spacer 1 (targeting *E. coli* lacZ) | nucleotide | artificial sequence | |
| spacer | | 137 | MGC3-7 sgRNA spacer 2 (targeting *E. coli* lacZ) | nucleotide | artificial sequence | |
| spacer | | 138 | MGC3-7 sgRNA spacer 3 (targeting *E. coli* lacZ) | nucleotide | artificial sequence | |
| spacer | | 139 | MGC3-8 sgRNA spacer 1 (targeting *E. coli* lacZ) | nucleotide | artificial sequence | |
| spacer | | 140 | MGC3-8 sgRNA spacer 2 (targeting *E. coli* lacZ) | nucleotide | artificial sequence | |
| spacer | | 141 | MGC3-8 sgRNA spacer 3 (targeting *E. coli* lacZ) | nucleotide | artificial sequence | |
| spacer | | 142 | MGC4-5 sgRNA spacer 1 (targeting *E. coli* lacZ) | nucleotide | artificial sequence | |
| spacer | | 143 | MGC4-5 sgRNA spacer 2 (targeting *E. coli* lacZ) | nucleotide | artificial sequence | |

TABLE 2-continued

| Category | Sequence Number | SEQ ID NO: | Description | Type | Organism | Other Information or Sequence |
|---|---|---|---|---|---|---|
| spacer | | 144 | MGC4-5 sgRNA spacer 3 (targeting *E. coli* lacZ) | nucleotide | artificial sequence | |
| spacer | | 145 | MGC14-1 sgRNA spacer 1 (targeting *E. coli* lacZ) | nucleotide | artificial sequence | |
| spacer | | 146 | MGC14-1 sgRNA spacer 2 (targeting *E. coli* lacZ) | nucleotide | artificial sequence | |
| spacer | | 147 | MGC14-1 sgRNA spacer 3 (targeting *E. coli* lacZ) | nucleotide | artificial sequence | |
| spacer | | 148 | MGC15-1 sgRNA spacer 1 (targeting *E. coli* lacZ) | nucleotide | artificial sequence | |
| spacer | | 149 | MGC15-1 sgRNA spacer 2 (targeting *E. coli* lacZ) | nucleotide | artificial sequence | |
| spacer | | 150 | MGC15-1 sgRNA spacer 3 (targeting *E. coli* lacZ) | nucleotide | artificial sequence | |
| spacer | | 151 | MGC18-1 sgRNA spacer 1 (targeting *E. coli* lacZ) | nucleotide | artificial sequence | |
| spacer | | 152 | MGC18-1 sgRNA spacer 2 (targeting *E. coli* lacZ) | nucleotide | artificial sequence | |
| spacer | | 153 | MGC18-1 sgRNA spacer 3 (targeting *E. coli* lacZ) | nucleotide | artificial sequence | |
| spacer | | 154 | BE3 sgRNA spacer 1 (targeting *E. coli* lacZ) | nucleotide | artificial sequence | |
| spacer | | 155 | BE3 sgRNA spacer 2 (targeting *E. coli* lacZ) | nucleotide | artificial sequence | |
| spacer | | 156 | BE3 sgRNA spacer 3 (targeting *E. coli* lacZ) | nucleotide | artificial sequence | |
| primer | | 157 | Site-directed mutagenesis of MG1-4 (D9A) | nucleotide | artificial sequence | |
| primer | | 158 | Site-directed mutagenesis of MG1-4 (D9A) | nucleotide | artificial sequence | |
| primer | | 159 | Site-directed mutagenesis of MG1-6 (D13A) | nucleotide | artificial sequence | |
| primer | | 160 | Site-directed mutagenesis of MG1-6 (D13A) | nucleotide | artificial sequence | |
| primer | | 161 | Site-directed mutagenesis of MG3-6 (D13A) | nucleotide | artificial sequence | |
| primer | | 162 | Site-directed mutagenesis of MG3-6 (D13A) | nucleotide | artificial sequence | |
| primer | | 163 | Site-directed mutagenesis of MG3-7 (D12A) | nucleotide | artificial sequence | |
| primer | | 164 | Site-directed mutagenesis of MG3-7 (D12A) | nucleotide | artificial sequence | |
| primer | | 165 | Site-directed mutagenesis of MG3-8 (D13A) | nucleotide | artificial sequence | |
| primer | | 166 | Site-directed mutagenesis of MG3-8 (D13A) | nucleotide | artificial sequence | |
| primer | | 167 | Site-directed mutagenesis of MG4-5 (D17A) | nucleotide | artificial sequence | |
| primer | | 168 | Site-directed mutagenesis of MG4-5 (D17A) | nucleotide | artificial sequence | |
| primer | | 169 | Site-directed mutagenesis of MG14-1 (D23A) | nucleotide | artificial sequence | |
| primer | | 170 | Site-directed mutagenesis of MG14-1 (D23A) | nucleotide | artificial sequence | |
| primer | | 171 | Site-directed mutagenesis of MG15-1 (D8A) | nucleotide | artificial sequence | |
| primer | | 172 | Site-directed mutagenesis of MG15-1 (D8A) | nucleotide | artificial sequence | |
| primer | | 173 | Site-directed mutagenesis of MG18-1 (D12A) | nucleotide | artificial sequence | |
| primer | | 174 | Site-directed mutagenesis of MG18-1 (D12A) | nucleotide | artificial sequence | |
| primer | | 175 | Site-directed mutagenesis of SpCas9 (D10A) | nucleotide | artificial sequence | |
| primer | | 176 | Site-directed mutagenesis of SpCas9 (D10A) | nucleotide | artificial sequence | |
| primer | | 177 | For lacZ sequencing | nucleotide | artificial sequence | |
| primer | | 178 | For lacZ sequencing | nucleotide | artificial sequence | |
| primer | | 179 | Amplify the fragment for nickase assay | nucleotide | artificial sequence | |
| primer | | 180 | Amplify the fragment for nickase assay | nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| primer | | 181 | Amplify T7 promoter-His tag-adenine deaminase for MGA entry plasmid | nucleotide | artificial sequence | |
| primer | | 182 | Amplify T7 promoter-His tag-adenine deaminase for MGA entry plasmid | nucleotide | artificial sequence | |
| primer | | 183 | Amplify SV40 NLS-vector backbone for MGA entry plasmid | nucleotide | artificial sequence | |
| primer | | 184 | Amplify SV40 NLS-vector backbone for MGA entry plasmid | nucleotide | artificial sequence | |
| primer | | 185 | Amplify vector backbone for MGA entry plasmid | nucleotide | artificial sequence | |
| primer | | 186 | Amplify vector backbone for MGA entry plasmid | nucleotide | artificial sequence | |
| primer | | 187 | Amplify T7 promoter-His-tag-cytosine deaminase for MGC entry plasmid | nucleotide | artificial sequence | |
| primer | | 188 | Amplify T7 promoter-His-tag-cytosine deaminase for MGC entry plasmid | nucleotide | artificial sequence | |
| primer | | 189 | Amplify UGI-SV40 NLS for MGC entry plasmid | nucleotide | artificial sequence | |
| primer | | 190 | Amplify UGI-SV40 NLS for MGC entry plasmid | nucleotide | artificial sequence | |
| primer | | 191 | Amplify SV40 NLS-vector backbone for MGC entry plasmid | nucleotide | artificial sequence | |
| primer | | 192 | Amplify SV40 NLS-vector backbone for MGC entry plasmid | nucleotide | artificial sequence | |
| primer | | 193 | Amplify vector backbone for MGC entry plasmid | nucleotide | artificial sequence | |
| primer | | 194 | Amplify vector backbone for MGC entry plasmid | nucleotide | artificial sequence | |
| primer | | 195 | Amplify nMG1-4 (D9A) for pMGA expression plasmid | nucleotide | artificial sequence | |
| primer | | 196 | Amplify nMG1-4 (D9A) for pMGA expression plasmid | nucleotide | artificial sequence | |
| primer | | 197 | Amplify nMG1-6 (D13A) for pMGA expression plasmid | nucleotide | artificial sequence | |
| primer | | 198 | Amplify nMG1-6 (D13A) for pMGA expression plasmid | nucleotide | artificial sequence | |
| primer | | 199 | Amplify nMG3-6 (D13A) for pMGA expression plasmid | nucleotide | artificial sequence | |
| primer | | 200 | Amplify nMG3-6 (D13A) for pMGA expression plasmid | nucleotide | artificial sequence | |
| primer | | 201 | Amplify nMG3-7 (D12A) for pMGA expression plasmid | nucleotide | artificial sequence | |
| primer | | 202 | Amplify nMG3-7 (D12A) for pMGA expression plasmid | nucleotide | artificial sequence | |
| primer | | 203 | Amplify nMG3-8 (D13A) for pMGA expression plasmid | nucleotide | artificial sequence | |
| primer | | 204 | Amplify nMG3-8 (D13A) for pMGA expression plasmid | nucleotide | artificial sequence | |
| primer | | 205 | Amplify nMG4-5 (D17A) for pMGA expression plasmid | nucleotide | artificial sequence | |
| primer | | 206 | Amplify nMG4-5 (D17A) for pMGA expression plasmid | nucleotide | artificial sequence | |
| primer | | 207 | Amplify nMG14-1 (D23A) for pMGA expression plasmid | nucleotide | artificial sequence | |
| primer | | 208 | Amplify nMG14-1 (D23A) for pMGA expression plasmid | nucleotide | artificial sequence | |
| primer | | 209 | Amplify nMG15-1 (D8A) for pMGA expression plasmid | nucleotide | artificial sequence | |
| primer | | 210 | Amplify nMG15-1 (D8A) for pMGA expression plasmid | nucleotide | artificial sequence | |
| primer | | 211 | Amplify nMG18-1 (D12A) for pMGA expression plasmid | nucleotide | artificial sequence | |
| primer | | 212 | Amplify nMG18-1 (D12A) for pMGA expression plasmid | nucleotide | artificial sequence | |
| primer | | 213 | Amplify SpCas9 (D10A) for pMGA expression plasmid | nucleotide | artificial sequence | |
| primer | | 214 | Amplify SpCas9 (D10A) for pMGA expression plasmid | nucleotide | artificial sequence | |
| primer | | 215 | Amplify nMG1-4 (D9A) for pMGC expression plasmid | nucleotide | artificial sequence | |
| primer | | 216 | Amplify nMG1-4 (D9A) for pMGC expression plasmid | nucleotide | artificial sequence | |
| primer | | 217 | Amplify nMG1-6 (D13A) for pMGC expression plasmid | nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| primer | | 218 | Amplify nMG1-6 (D13A) for pMGC expression plasmid | nucleotide | artificial sequence | |
| primer | | 219 | Amplify nMG3-6 (D13A) for pMGC expression plasmid | nucleotide | artificial sequence | |
| primer | | 220 | Amplify nMG3-6 (D13A) for pMGC expression plasmid | nucleotide | artificial sequence | |
| primer | | 221 | Amplify nMG3-7 (D12A) for pMGC expression plasmid | nucleotide | artificial sequence | |
| primer | | 222 | Amplify nMG3-7 (D12A) for pMGC expression plasmid | nucleotide | artificial sequence | |
| primer | | 223 | Amplify nMG3-8 (D13A) for pMGC expression plasmid | nucleotide | artificial sequence | |
| primer | | 224 | Amplify nMG3-8 (D13A) for pMGC expression plasmid | nucleotide | artificial sequence | |
| primer | | 225 | Amplify nMG4-5 (D17A) for pMGC expression plasmid | nucleotide | artificial sequence | |
| primer | | 226 | Amplify nMG4-5 (D17A) for pMGC expression plasmid | nucleotide | artificial sequence | |
| primer | | 227 | Amplify nMG14-1 (D23A) for pMGC expression plasmid | nucleotide | artificial sequence | |
| primer | | 228 | Amplify nMG14-1 (D23A) for pMGC expression plasmid | nucleotide | artificial sequence | |
| primer | | 229 | Amplify nMG15-1 (D8A) for pMGC expression plasmid | nucleotide | artificial sequence | |
| primer | | 230 | Amplify nMG15-1 (D8A) for pMGC expression plasmid | nucleotide | artificial sequence | |
| primer | | 231 | Amplify nMG18-1 (D12A) for pMGC expression plasmid | nucleotide | artificial sequence | |
| primer | | 232 | Amplify nMG18-1 (D12A) for pMGC expression plasmid | nucleotide | artificial sequence | |
| primer | | 233 | Amplify SpCas9 (D10A) for pMGC expression plasmid | nucleotide | artificial sequence | |
| primer | | 234 | Amplify SpCas9 (D10A) for pMGC expression plasmid | nucleotide | artificial sequence | |
| primer | | 235 | Amplify MGA1-4_sgRNA spacer 1 | nucleotide | artificial sequence | |
| primer | | 236 | Amplify MGA1-4_sgRNA spacer 1 | nucleotide | artificial sequence | |
| primer | | 237 | Amplify MGA1-4_sgRNA spacer 2 | nucleotide | artificial sequence | |
| primer | | 238 | Amplify MGA1-4_sgRNA spacer 2 | nucleotide | artificial sequence | |
| primer | | 239 | Amplify MGA1-4_sgRNA spacer 3 | nucleotide | artificial sequence | |
| primer | | 240 | Amplify MGA1-4_sgRNA spacer 3 | nucleotide | artificial sequence | |
| primer | | 241 | Amplify MGA1-6_sgRNA spacer 1 | nucleotide | artificial sequence | |
| primer | | 242 | Amplify MGA1-6_sgRNA spacer 1 | nucleotide | artificial sequence | |
| primer | | 243 | Amplify MGA1-6_sgRNA spacer 2 | nucleotide | artificial sequence | |
| primer | | 244 | Amplify MGA1-6_sgRNA spacer 2 | nucleotide | artificial sequence | |
| primer | | 245 | Amplify MGA1-6_sgRNA spacer 3 | nucleotide | artificial sequence | |
| primer | | 246 | Amplify MGA1-6_sgRNA spacer 3 | nucleotide | artificial sequence | |
| primer | | 247 | Amplify MGA3-6_sgRNA spacer 1 | nucleotide | artificial sequence | |
| primer | | 248 | Amplify MGA3-6_sgRNA spacer 1 | nucleotide | artificial sequence | |
| primer | | 249 | Amplify MGA3-6_sgRNA spacer 2 | nucleotide | artificial sequence | |
| primer | | 250 | Amplify MGA3-6_sgRNA spacer 2 | nucleotide | artificial sequence | |
| primer | | 251 | Amplify MGA3-6_sgRNA spacer 3 | nucleotide | artificial sequence | |
| primer | | 252 | Amplify MGA3-6_sgRNA spacer 3 | nucleotide | artificial sequence | |
| primer | | 253 | Amplify MGA3-7_sgRNA spacer 1 | nucleotide | artificial sequence | |
| primer | | 254 | Amplify MGA3-7_sgRNA spacer 1 | nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| primer | | 255 | Amplify MGA3-7_sgRNA spacer 2 | nucleotide | artificial sequence | |
| primer | | 256 | Amplify MGA3-7_sgRNA spacer 2 | nucleotide | artificial sequence | |
| primer | | 257 | Amplify MGA3-7_sgRNA spacer 3 | nucleotide | artificial sequence | |
| primer | | 258 | Amplify MGA3-7_sgRNA spacer 3 | nucleotide | artificial sequence | |
| primer | | 259 | Amplify MGA4-5_sgRNA spacer 1 | nucleotide | artificial sequence | |
| primer | | 260 | Amplify MGA4-5_sgRNA spacer 1 | nucleotide | artificial sequence | |
| primer | | 261 | Amplify MGA4-5_sgRNA spacer 2 | nucleotide | artificial sequence | |
| primer | | 262 | Amplify MGA4-5_sgRNA spacer 2 | nucleotide | artificial sequence | |
| primer | | 263 | Amplify MGA4-5_sgRNA spacer 3 | nucleotide | artificial sequence | |
| primer | | 264 | Amplify MGA4-5_sgRNA spacer 3 | nucleotide | artificial sequence | |
| primer | | 265 | Amplify MGA14-1_sgRNA spacer 1 | nucleotide | artificial sequence | |
| primer | | 266 | Amplify MGA14-1_sgRNA spacer 1 | nucleotide | artificial sequence | |
| primer | | 267 | Amplify MGA14-1_sgRNA spacer 2 | nucleotide | artificial sequence | |
| primer | | 268 | Amplify MGA14-1_sgRNA spacer 2 | nucleotide | artificial sequence | |
| primer | | 269 | Amplify MGA14-1_sgRNA spacer 3 | nucleotide | artificial sequence | |
| primer | | 270 | Amplify MGA14-1_sgRNA spacer 3 | nucleotide | artificial sequence | |
| primer | | 271 | Amplify MGA15-1_sgRNA spacer 1 | nucleotide | artificial sequence | |
| primer | | 272 | Amplify MGA15-1_sgRNA spacer 1 | nucleotide | artificial sequence | |
| primer | | 273 | Amplify MGA15-1_sgRNA spacer 2 | nucleotide | artificial sequence | |
| primer | | 274 | Amplify MGA15-1_sgRNA spacer 2 | nucleotide | artificial sequence | |
| primer | | 275 | Amplify MGA15-1_sgRNA spacer 3 | nucleotide | artificial sequence | |
| primer | | 276 | Amplify MGA15-1_sgRNA spacer 3 | nucleotide | artificial sequence | |
| primer | | 277 | Amplify MGA18-1_sgRNA spacer 1 | nucleotide | artificial sequence | |
| primer | | 278 | Amplify MGA18-1_sgRNA spacer 1 | nucleotide | artificial sequence | |
| primer | | 279 | Amplify MGA18-1_sgRNA spacer 2 | nucleotide | artificial sequence | |
| primer | | 280 | Amplify MGA18-1_sgRNA spacer 2 | nucleotide | artificial sequence | |
| primer | | 281 | Amplify MGA18-1_sgRNA spacer 3 | nucleotide | artificial sequence | |
| primer | | 282 | Amplify MGA18-1_sgRNA spacer 3 | nucleotide | artificial sequence | |
| primer | | 283 | Amplify ABE8.17m_sgRNA spacer 1 | nucleotide | artificial sequence | |
| primer | | 284 | Amplify ABE8.17m_sgRNA spacer 1 | nucleotide | artificial sequence | |
| primer | | 285 | Amplify ABE8.17m_sgRNA spacer 2 | nucleotide | artificial sequence | |
| primer | | 286 | Amplify ABE8.17m_sgRNA spacer 2 | nucleotide | artificial sequence | |
| primer | | 287 | Amplify ABE8.17m_sgRNA spacer 3 | nucleotide | artificial sequence | |
| primer | | 288 | Amplify ABE8.17m_sgRNA spacer 3 | nucleotide | artificial sequence | |
| primer | | 289 | Amplify MGC1-4_spacer 1 | nucleotide | artificial sequence | |
| primer | | 290 | Amplify MGC1-4_spacer 1 | nucleotide | artificial sequence | |
| primer | | 291 | Amplify MGC1-4_spacer 2 | nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| primer | | 292 | Amplify MGC1-4_spacer 2 | nucleotide | artificial sequence | |
| primer | | 293 | Amplify MGC1-4_spacer 3 | nucleotide | artificial sequence | |
| primer | | 294 | Amplify MGC1-4_spacer 3 | nucleotide | artificial sequence | |
| primer | | 295 | Amplify MGC1-6_spacer 1 | nucleotide | artificial sequence | |
| primer | | 296 | Amplify MGC1-6_spacer 1 | nucleotide | artificial sequence | |
| primer | | 297 | Amplify MGC1-6_spacer 2 | nucleotide | artificial sequence | |
| primer | | 298 | Amplify MGC1-6_spacer 2 | nucleotide | artificial sequence | |
| primer | | 299 | Amplify MGC1-6_spacer 3 | nucleotide | artificial sequence | |
| primer | | 300 | Amplify MGC1-6_spacer 3 | nucleotide | artificial sequence | |
| primer | | 301 | Amplify MGC3-6_spacer 1 | nucleotide | artificial sequence | |
| primer | | 302 | Amplify MGC3-6_spacer 1 | nucleotide | artificial sequence | |
| primer | | 303 | Amplify MGC3-6_spacer 2 | nucleotide | artificial sequence | |
| primer | | 304 | Amplify MGC3-6_spacer 2 | nucleotide | artificial sequence | |
| primer | | 305 | Amplify MGC3-6_spacer 3 | nucleotide | artificial sequence | |
| primer | | 306 | Amplify MGC3-6_spacer 3 | nucleotide | artificial sequence | |
| primer | | 307 | Amplify MGC3-7_spacer 1 | nucleotide | artificial sequence | |
| primer | | 308 | Amplify MGC3-7_spacer 1 | nucleotide | artificial sequence | |
| primer | | 309 | Amplify MGC3-7_spacer 2 | nucleotide | artificial sequence | |
| primer | | 310 | Amplify MGC3-7_spacer 2 | nucleotide | artificial sequence | |
| primer | | 311 | Amplify MGC3-7_spacer 3 | nucleotide | artificial sequence | |
| primer | | 312 | Amplify MGC3-7_spacer 3 | nucleotide | artificial sequence | |
| primer | | 313 | Amplify MGC4-5_spacer 1 | nucleotide | artificial sequence | |
| primer | | 314 | Amplify MGC4-5_spacer 1 | nucleotide | artificial sequence | |
| primer | | 315 | Amplify MGC4-5_spacer 2 | nucleotide | artificial sequence | |
| primer | | 316 | Amplify MGC4-5_spacer 2 | nucleotide | artificial sequence | |
| primer | | 317 | Amplify MGC4-5_spacer 3 | nucleotide | artificial sequence | |
| primer | | 318 | Amplify MGC4-5_spacer 3 | nucleotide | artificial sequence | |
| primer | | 319 | Amplify MGC14-1_spacer 1 | nucleotide | artificial sequence | |
| primer | | 320 | Amplify MGC14-1_spacer 1 | nucleotide | artificial sequence | |
| primer | | 321 | Amplify MGC14-1_spacer 2 | nucleotide | artificial sequence | |
| primer | | 322 | Amplify MGC14-1_spacer 2 | nucleotide | artificial sequence | |
| primer | | 323 | Amplify MGC14-1_spacer 3 | nucleotide | artificial sequence | |
| primer | | 324 | Amplify MGC14-1_spacer 3 | nucleotide | artificial sequence | |
| primer | | 325 | Amplify MGC15-1_spacer 1 | nucleotide | artificial sequence | |
| primer | | 326 | Amplify MGC15-1_spacer 1 | nucleotide | artificial sequence | |
| primer | | 327 | Amplify MGC15-1_spacer 2 | nucleotide | artificial sequence | |
| primer | | 328 | Amplify MGC15-1_spacer 2 | nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| primer | | 329 | Amplify MGC15-1_spacer 3 | nucleotide | artificial sequence | |
| primer | | 330 | Amplify MGC15-1_spacer 3 | nucleotide | artificial sequence | |
| primer | | 331 | Amplify MGC18-1_spacer 1 | nucleotide | artificial sequence | |
| primer | | 332 | Amplify MGC18-1_spacer 1 | nucleotide | artificial sequence | |
| primer | | 333 | Amplify MGC18-1_spacer 2 | nucleotide | artificial sequence | |
| primer | | 334 | Amplify MGC18-1_spacer 2 | nucleotide | artificial sequence | |
| primer | | 335 | Amplify MGC18-1_spacer 3 | nucleotide | artificial sequence | |
| primer | | 336 | Amplify MGC18-1_spacer 3 | nucleotide | artificial sequence | |
| primer | | 337 | Amplify BE3_sgRNA spacer 1 | nucleotide | artificial sequence | |
| primer | | 338 | Amplify BE3_sgRNA spacer 1 | nucleotide | artificial sequence | |
| primer | | 339 | Amplify BE3_sgRNA spacer 2 | nucleotide | artificial sequence | |
| primer | | 340 | Amplify BE3_sgRNA spacer 2 | nucleotide | artificial sequence | |
| primer | | 341 | Amplify BE3_sgRNA spacer 3 | nucleotide | artificial sequence | |
| primer | | 342 | Amplify BE3_sgRNA spacer 3 | nucleotide | artificial sequence | |
| primer | | 343 | For lacZ sequencing | nucleotide | artificial sequence | |
| primer | | 344 | For lacZ sequencing | nucleotide | artificial sequence | |
| primer | | 345 | For lacZ sequencing | nucleotide | artificial sequence | |
| primer | | 346 | Amplify sgRNA expression cassette | nucleotide | artificial sequence | |
| primer | | 347 | Amplify sgRNA expression cassette | nucleotide | artificial sequence | |
| primer | | 348 | Amplify MGA3-8_sgRNA spacer 1 | nucleotide | artificial sequence | |
| primer | | 349 | Amplify MGA3-8_sgRNA spacer 1 | nucleotide | artificial sequence | |
| primer | | 350 | Amplify MGA3-8_sgRNA spacer 2 | nucleotide | artificial sequence | |
| primer | | 351 | Amplify MGA3-8_sgRNA spacer 2 | nucleotide | artificial sequence | |
| primer | | 352 | Amplify MGA3-8_sgRNA spacer 3 | nucleotide | artificial sequence | |
| primer | | 353 | Amplify MGA3-8_sgRNA spacer 3 | nucleotide | artificial sequence | |
| primer | | 354 | Amplify MGC3-8_sgRNA spacer 1 | nucleotide | artificial sequence | |
| primer | | 355 | Amplify MGC3-8_sgRNA spacer 1 | nucleotide | artificial sequence | |
| primer | | 356 | Amplify MGC3-8_sgRNA spacer 2 | nucleotide | artificial sequence | |
| primer | | 357 | Amplify MGC3-8_sgRNA spacer 2 | nucleotide | artificial sequence | |
| primer | | 358 | Amplify MGC3-8_sgRNA spacer 3 | nucleotide | artificial sequence | |
| primer | | 359 | Amplify MGC3-8_sgRNA spacer 3 | nucleotide | artificial sequence | |
| PAM | A360 | | nMG1-4 (D9A) nickase PAM | nucleotide | artificial sequence | nRRR |
| PAM | A361 | | nMG1-6 (D13A) nickase PAM | nucleotide | artificial sequence | nnRRAY |
| PAM | A362 | | nMG3-6 (D13A) nickase PAM | nucleotide | artificial sequence | nnRGGnT |
| PAM | A363 | | nMG3-7 (D12A) nickase PAM | nucleotide | artificial sequence | nnRnYAY |
| PAM | A364 | | nMG3-8 (D13A) nickase PAM | nucleotide | artificial sequence | nnRGGTY |
| PAM | A365 | | nMG4-5 (D17A) nickase PAM | nucleotide | artificial sequence | nRCCV |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| PAM | A366 | | nMG14-1 (D23A) nickase PAM | nucleotide | artificial sequence | nRnnGRKA |
| PAM | A367 | | nMG15-1 (D8A) nickase PAM | nucleotide | artificial sequence | nnnnC |
| PAM | | 368 | nMG18-1 (D12A) nickase PAM | nucleotide | artificial sequence | nRWART |
| NLS | | 369 | SV40 | nucleotide | artificial sequence | Nuclear localization sequence |
| NLS | | 370 | nucleoplasmin bipartite NLS | nucleotide | | Nuclear localization sequence |
| NLS | | 371 | c-myc NLS | nucleotide | | Nuclear localization sequence |
| NLS | | 372 | c-myc NLS | nucleotide | | Nuclear localization sequence |
| NLS | | 373 | bRNPA1 M9 NLS | nucleotide | | Nuclear localization sequence |
| NLS | | 374 | Importin-alpha IBB domain | nucleotide | | Nuclear localization sequence |
| NLS | | 375 | Myoma T protein | nucleotide | | Nuclear localization sequence |
| NLS | | 376 | Myoma T protein | nucleotide | | Nuclear localization sequence |
| NLS | | 377 | p53 | nucleotide | | Nuclear localization sequence |
| NLS | | 378 | mouse c-abl IV | nucleotide | | Nuclear localization sequence |
| NLS | | 379 | influenza virus NS1 | nucleotide | | Nuclear localization sequence |
| NLS | | 380 | influenza virus NS1 | nucleotide | | Nuclear localization sequence |
| NLS | | 381 | Hepatitis virus delta antigen | nucleotide | | Nuclear localization sequence |
| NLS | | 382 | mouse Mx1 protein | nucleotide | | Nuclear localization sequence |
| NLS | | 383 | human poly(ADP-ribose) polymerase | nucleotide | | Nuclear localization sequence |
| NLS | | 384 | steroid hormone receptor (human) glucocorticoid | nucleotide | | Nuclear localization sequence |
| MG68 putative adenosine deaminase (TadA-like) | | 385 | MG68-3 deaminase | protein | unknown | uncultivated organism |
| MG68 putative adenosine deaminase (TadA-like) | | 386 | MG68-4 deaminase | protein | unknown | uncultivated organism |
| MG68 putative adenosine deaminase (TadA-like) | | 387 | MG68-5 deaminase | protein | unknown | uncultivated organism |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG68 putative adenosine deaminase (TadA-like) | | 388 | MG68-6 deaminase | protein | unknown | uncultivated organism |
| MG68 putative adenosine deaminase (TadA-like) | | 389 | MG68-7 deaminase | protein | unknown | uncultivated organism |
| MG68 putative adenosine deaminase (TadA-like) | | 390 | MG68-8 deaminase | protein | unknown | uncultivated organism |
| MG68 putative adenosine deaminase (TadA-like) | | 391 | MG68-9 deaminase | protein | unknown | uncultivated organism |
| MG68 putative adenosine deaminase (TadA-like | | 392 | MG68-10 deaminase | protein | unknown | uncultivated organism |
| MG68 putative adenosine deaminase (TadA-like) | | 393 | MG68-11 deaminase | protein | unknown | uncultivated organism |
| MG68 putative adenosine deaminase (TadA-like) | | 394 | MG68-12 deaminase | protein | unknown | uncultivated organism |
| MG68 putative adenosine deaminase (TadA-like) | | 395 | MG68-13 deaminase | protein | unknown | uncultivated organism |
| MG68 putative adenosine deaminase (TadA-like) | | 396 | MG68-14 deaminase | protein | unknown | uncultivated organism |
| MG68 putative adenosine deaminase (TadA-like) | | 397 | MG68-15 deaminase | protein | unknown | uncultivated organism |
| MG68 putative adenosine deaminase (TadA-like) | | 398 | MG68-16 deaminase | protein | unknown | uncultivated organism |
| MG68 putative adenosine deaminase (TadA-like) | | 399 | MG68-17 deaminase | protein | unknown | uncultivated organism |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG68 putative adenosine deaminase (TadA-like) | | 400 | MG68-18 deaminase | protein | unknown | uncultivated organism |
| MG68 putative adenosine deaminase (TadA-like) | | 401 | MG68-19 deaminase | protein | unknown | uncultivated organism |
| MG68 putative adenosine deaminase (TadA-like) | | 402 | MG68-20 deaminase | protein | unknown | uncultivated organism |
| MG68 putative adenosine deaminase (TadA-like) | | 403 | MG68-21 deaminase | protein | unknown | uncultivated organism |
| MG68 putative adenosine deaminase (TadA-like) | | 404 | MG68-22 deaminase | protein | unknown | uncultivated organism |
| MG68 putative adenosine deaminase (TadA-like) | | 405 | MG68-23 deaminase | protein | unknown | uncultivated organism |
| MG68 putative adenosine deaminase (TadA-like) | | 406 | MG68-24 deaminase | protein | unknown | uncultivated organism |
| MG68 putative adenosine deaminase (TadA-like) | | 407 | MG68-25 deaminase | protein | unknown | uncultivated organism |
| MG68 putative adenosine deaminase (TadA-like) | | 408 | MG68-26 deaminase | protein | unknown | uncultivated organism |
| MG68 putative adenosine deaminase (TadA-like) | | 409 | MG68-27 deaminase | protein | unknown | uncultivated organism |
| MG68 putative adenosine deaminase (TadA-like) | | 410 | MG68-28 deaminase | protein | unknown | uncultivated organism |
| MG68 putative adenosine deaminase (TadA-like) | | 411 | MG68-29 deaminase | protein | unknown | uncultivated organism |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG68 putative adenosine deaminase (TadA-like) | | 412 | MG68-30 deaminase | protein | unknown | uncultivated organism |
| MG68 putative adenosine deaminase (TadA-like) | | 413 | MG68-31 deaminase | protein | unknown | uncultivated organism |
| MG68 putative adenosine deaminase (TadA-like) | | 414 | MG68-32 deaminase | protein | unknown | uncultivated organism |
| MG68 putative adenosine deaminase (TadA-like) | | 415 | MG68-33 deaminase | protein | unknown | uncultivated organism |
| MG68 putative adenosine deaminase (TadA-like) | | 416 | MG68-34 deaminase | protein | unknown | uncultivated organism |
| MG68 putative adenosine deaminase (TadA-like) | | 417 | MG68-35 deaminase | protein | unknown | uncultivated organism |
| MG68 putative adenosine deaminase (TadA-like) | | 418 | MG68-36 deaminase | protein | unknown | uncultivated organism |
| MG68 putative adenosine deaminase (TadA-like) | | 419 | MG68-37 deaminase | protein | unknown | uncultivated organism |
| MG68 putative adenosine deaminase (TadA-like) | | 420 | MG68-38 deaminase | protein | unknown | uncultivated organism |
| MG68 putative adenosine deaminase (TadA-like) | | 421 | MG68-39 deaminase | protein | unknown | uncultivated organism |
| MG68 putative adenosine deaminase (TadA-like) | | 422 | MG68-40 deaminase | protein | unknown | uncultivated organism |
| MG68 putative adenosine deaminase (TadA-like) | | 423 | MG68-41 deaminase | protein | unknown | uncultivated organism |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG68 putative adenosine deaminase (TadA-like) | | 424 | MG68-42 deaminase | protein | unknown | uncultivated organism |
| MG68 putative adenosine deaminase (TadA-like) | | 425 | MG68-43 deaminase | protein | unknown | uncultivated organism |
| MG68 putative adenosine deaminase (TadA-like) | | 426 | MG68-44 deaminase | protein | unknown | uncultivated organism |
| MG68 putative adenosine deaminase (TadA-like) | | 427 | MG68-45 deaminase | protein | unknown | uncultivated organism |
| MG68 putative adenosine deaminase (TadA-like) | | 428 | MG68-46 deaminase | protein | unknown | uncultivated organism |
| MG68 putative adenosine deaminase (TadA-like) | | 429 | MG68-47 deaminase | protein | unknown | uncultivated organism |
| MG68 putative adenosine deaminase (TadA-like) | | 430 | MG68-48 deaminase | protein | unknown | uncultivated organism |
| MG68 putative adenosine deaminase (TadA-like) | | 431 | MG68-49 deaminase | protein | unknown | uncultivated organism |
| MG68 putative adenosine deaminase (TadA-like) | | 432 | MG68-50 deaminase | protein | unknown | uncultivated organism |
| MG68 putative adenosine deaminase (TadA-like) | | 433 | MG68-51 deaminase | protein | unknown | uncultivated organism |
| MG68 putative adenosine deaminase (TadA-like) | | 434 | MG68-52 deaminase | protein | unknown | uncultivated organism |
| MG68 putative adenosine deaminase (TadA-like) | | 435 | MG68-53 deaminase | protein | unknown | uncultivated organism |

TABLE 2-continued

| Category | Sequence Number | SEQ ID NO: | Description | Type | Organism | Other Information or Sequence |
|---|---|---|---|---|---|---|
| Sequence Listing of Protein and Nucleic Acid Sequences Referred to Herein | | | | | | |
| MG68 putative adenosine deaminase (TadA-like) | | 436 | MG68-54 deaminase | protein | unknown | uncultivated organism |
| MG68 putative adenosine deaminase (TadA-like) | | 437 | MG68-55 deaminase | protein | unknown | uncultivated organism |
| MG68 putative adenosine deaminase (TadA-like) | | 438 | MG68-56 deaminase | protein | unknown | uncultivated organism |
| MG68 putative adenosine deaminase (TadA-like) | | 439 | MG68-57 deaminase | protein | unknown | uncultivated organism |
| MG68 putative adenosine deaminase (TadA-like) | | 440 | MG68-58 deaminase | protein | unknown | uncultivated organism |
| MG68 putative adenosine deaminase (TadA-like) | | 441 | MG68-59 deaminase | protein | unknown | uncultivated organism |
| MG68 putative adenosine deaminase (TadA-like) | | 442 | MG68-60 deaminase | protein | unknown | uncultivated organism |
| MG68 putative adenosine deaminase (TadA-like) | | 443 | MG68-61 deaminase | protein | unknown | uncultivated organism |
| MG121 deaminase | | 444 | MG121-1 deaminase | protein | unknown | uncultivated organism |
| MG121 deaminase | | 445 | MG121-2 deaminase | protein | unknown | uncultivated organism |
| MG121 deaminase | | 446 | MG121-3 deaminase | protein | unknown | uncultivated organism |
| MG121 deaminase | | 447 | MG121-4 deaminase | protein | unknown | uncultivated organism |
| MG68 putative adenosine deaminase (TadA-like) | | 448 | MG68-4_V1 | protein | artificial sequence | |
| MG68 putative adenosine deaminase (TadA-like) | | 449 | MG68-4_V2 | protein | artificial sequence | |
| MG68 putative adenosine deaminase (TadA-like) | | 450 | MG68-4_V3 | protein | artificial sequence | |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG68 putative adenosine deaminase (TadA-like) | | 451 | MG68-4_V4 | protein | artificial sequence | |
| MG68 putative adenosine deaminase (TadA-like) | | 452 | MG68-4_V5 | protein | artificial sequence | |
| MG68 putative adenosine deaminase (TadA-like) | | 453 | MG68-4_V6 | protein | artificial sequence | |
| MG68 putative adenosine deaminase (TadA-like) | | 454 | MG68-4_V7 | protein | artificial sequence | |
| MG68 putative adenosine deaminase (TadA-like) | | 455 | MG68-4_V8 | protein | artificial sequence | |
| MG68 putative adenosine deaminase (TadA-like) | | 456 | MG68-4_V9 | protein | artificial sequence | |
| MG68 putative adenosine deaminase (TadA-like) | | 457 | MG68-4_V10 | protein | artificial sequence | |
| MG68 putative adenosine deaminase (TadA-like) | | 458 | MG68-4_V11 | protein | artificial sequence | |
| MG68 putative adenosine deaminase (TadA-like) | | 459 | MG68-4_V12 | protein | artificial sequence | |
| MG68 putative adenosine deaminase (TadA-like) | | 460 | MG68-4_V13 | protein | artificial sequence | |
| MG68 putative adenosine deaminase (TadA-like) | | 461 | MG68-4_V14 | protein | artificial sequence | |
| MG68 putative adenosine deaminase (TadA-like) | | 462 | MG68-4_V15 | protein | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG68 putative adenosine deaminase (TadA-like) | | 463 | MG68-4_V16 | protein | artificial sequence | |
| MG68 putative adenosine deaminase (TadA-like) | | 464 | MG68-4_V17 | protein | artificial sequence | |
| MG68 putative adenosine deaminase (TadA-like) | | 465 | MG68-4_V18 | protein | artificial sequence | |
| MG68 putative adenosine deaminase (TadA-like) | | 466 | MG68-4_V19 | protein | artificial sequence | |
| MG68 putative adenosine deaminase (TadA-like) | | 467 | MG68-4_V20 | protein | artificial sequence | |
| MG68 putative adenosine deaminase (TadA-like) | | 468 | MG68-4_V21 | protein | artificial sequence | |
| MG68 putative adenosine deaminase (TadA-like) | | 469 | MG68-4_V22 | protein | artificial sequence | |
| MG68 putative adenosine deaminase (TadA-like) | | 470 | MG68-4_V23 | protein | artificial sequence | |
| MG68 putative adenosine deaminase (TadA-like) | | 471 | MG68-4_V24 | protein | artificial sequence | |
| MG68 putative adenosine deaminase (TadA-like) | | 472 | MG68-4_V25 | protein | artificial sequence | |
| MG68 putative adenosine deaminase (TadA-like) | | 473 | MG68-4_V26 | protein | artificial sequence | |
| MG68 putative adenosine deaminase (TadA-like) | | 474 | MG68-4_V27 | protein | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG68 putative adenosine deaminase (TadA-like) | | 475 | MG68-4_V28 | protein | artificial sequence | |
| adenine base editor | | 476 | MG68-4_V1-nMG34-1 (D10A) | protein | artificial sequence | |
| adenine base editor | | 477 | MG68-4_V1-nSpCas9 (D10A) | protein | artificial sequence | |
| cytosine base editor | | 478 | rAPOBEC1-nMG15-1 (D8A) | protein | artificial sequence | |
| cytosine base editor | | 479 | rAPOBEC1-nMG15-1 (D&A)-UGI (PBS1) | protein | artificial sequence | |
| cytosine base editor | | 480 | rAPOBEC1-nMG15-1 (D8A)-MG69-1 | protein | artificial sequence | |
| cytosine base editor | | 481 | rAPOBEC1-nMG15-1 (D8A)-MG69-2 | protein | artificial sequence | |
| cytosine base editor | | 482 | rAPOBEC1-nMG15-1 (D8A)-MG69- | protein | artificial sequence | |
| Plasmid | | 483 | pET21-CAT (H193Y)-sgRNA-TadA-nSpCas9 (D10A) | nucleotide | artificial sequence | |
| Plasmid | | 484 | pET21-sgRNA-TadA (ABE8.17m)-nMG34-1 (D10A) | nucleotide | artificial sequence | |
| Plasmid | | 485 | pET21-sgRNA-rAPOBEC1-nMG34-1 (DIOA)-UGI (PBS1) | nucleotide | artificial sequence | |
| Plasmid | | 486 | pET21-CAT (H193Y)-sgRNA-MG68-4 (D109N)-nMG34-1 (D10A) | nucleotide | artificial sequence | |
| Plasmid | | 487 | pET21-CAT (H193Y)-sgRNA-MG68-4 (D109N)-nSpCas9 (D10A) | nucleotide | artificial sequence | |
| sgRNA scaffold sequence | | 488 | MG15-1 | nucleotide | artificial sequence | |
| sgRNA scaffold sequence | | 489 | MG34-1 | nucleotide | artificial sequence | |
| spacer | | 490 | rAPOBEC1-nMG15-1 (D8A) in *E. coli* | nucleotide | artificial sequence | |
| spacer | | 491 | rAPOBEC1-nMG15-1 (D8A)-UGI (PBS1) in *E. coli* | nucleotide | artificial sequence | |
| spacer | | 492 | rAPOBEC1-nMG15-1 (D8A)-MG69-1 in *E. coli* | nucleotide | artificial sequence | |
| spacer | | 493 | rAPOBEC1-nMG15-1 (D8A)-MG69-2 in *E. coli* | nucleotide | artificial sequence | |
| spacer | | 494 | rAPOBEC1-nMG15-1 (D8A)-MG69-3 in *E. coli* | nucleotide | artificial sequence | |
| spacer | | 495 | rAPOBEC1-nSpCas9 (D10A)-UGI (PBS1) in HEK293T | nucleotide | artificial sequence | |
| spacer | | 496 | rAPOBEC1-nSpCas9 (D10A) in HEK293T | nucleotide | artificial sequence | |
| spacer | | 497 | rAPOBEC1-nSpCas9 (D10A)~MG69-1 in HEK293T | nucleotide | artificial sequence | |
| spacer | | 498 | rAPOBEC1-nSpCas9 (D10A)-MG69-2 in HEK293T | nucleotide | artificial sequence | |
| spacer | | 499 | A0A2K5RDN7-nMG1-4 (D9A)-MG69-1_site 1 in HEK293T | nucleotide | artificial sequence | |
| spacer | | 500 | A0A2K5RDN7-nMG1-4 (D9A)-MG69-1_site 2 in HEK293T | nucleotide | artificial sequence | |
| spacer | | 501 | A0A2K5RDN7-nMG1-4 (D9A)-MG69-1_site 3 in HEK293T | nucleotide | artificial sequence | |
| spacer | | 502 | A0A2K5RDN7-nMG1-4 (D9A)-MG69-1_site 4 in HEK293T | nucleotide | artificial sequence | |
| spacer | | 503 | A0A2K5RDN7-nMG3-6 (D13A)-MG69-1_site 1 in HEK293T | nucleotide | artificial sequence | |
| spacer | | 504 | A0A2K5RDN7-nMG3-6 (D13A)-MG69-1_site 2 in HEK293T | nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| spacer | | 505 | A0A2KSRDN7-nMG3-6 (D13A)-MG69-1_site 3 in HEK293T | nucleotide | artificial sequence | |
| spacer | | 506 | A0A2K5RDN7-nMG3-6 (D13A)-MG69-1_site 4 in HEK293T | nucleotide | artificial sequence | |
| spacer | | 507 | A0A2K5RDN7-nMG3-6 (D13A)-MG69-1_site 5 in HEK293T | nucleotide | artificial sequence | |
| spacer | | 508 | A0A2K5RDN7-nMG3-6 (D13A)-MG69-1_site 6 in HEK293T | nucleotide | artificial sequence | |
| spacer | | 509 | A0A2K5RDN7-nMG3-6 (D13A)-MG69-1_site 7 in HEK293T | nucleotide | artificial sequence | |
| spacer | | 510 | A0A2K5RDN7-nMG4-2 (D28A)-MG69-1_site 1 in HEK293T | nucleotide | artificial sequence | |
| spacer | | 511 | A0A2K5RDN7-nMG4-2 (D28A)-MG69-1_site 2 in HEK293T | nucleotide | artificial sequence | |
| spacer | | 512 | A0A2K5RDN7-nMG4-2 (D28A)-MG69-1_site 3 in HEK293T | nucleotide | artificial sequence | |
| spacer | | 513 | A0A2K5RDN7-nMG4-2 (D28A)-MG69-1_site 4 in HEK293T | nucleotide | artificial sequence | |
| spacer | | 514 | A0A2K5RDN7-nMG18-1 (D12A)-MG69-1_site 1 in HEK293T | nucleotide | artificial sequence | |
| spacer | | 515 | A0A2K5RDN7-nMG18-1 (D12A)-MG69-1_site 2 in HEK293T | nucleotide | artificial sequence | |
| spacer | | 516 | A0A2K5RDN7-nMG18-1 (D12A)-MG69-1_site 3 in HEK293T | nucleotide | artificial sequence | |
| spacer | | 517 | A0A2K5RDN7-nMG18-1 (D12A)-MG69-1_site 4 in HEK293T | nucleotide | artificial sequence | |
| spacer | | 518 | A0A2K5RDN7-nSpCas9 (D10A)-MG69-1_site 1 in HEK293T | nucleotide | artificial sequence | |
| spacer | | 519 | A0A2K5RDN7-nSpCas9 (D10A)-MG69-1_site 2 in HEK293T | nucleotide | artificial sequence | |
| spacer | | 520 | A0A2K5RDN7-nSpCas9 (D10A)-MG69-1_site 3 in HEK293T | nucleotide | artificial sequence | |
| spacer | | 521 | A0A2K5RDN7-nSpCas9 (D10A)-MG69-1_site 4 in HEK293T | nucleotide | artificial sequence | |
| spacer | | 522 | A0A2K5RDN7-nSpCas9 (D10A)-MG69-1_site 5 in HEK293T | nucleotide | artificial sequence | |
| primer | | 523 | Forward primer used to amplify lacZ of *E. coli* and Sanger sequencing | nucleotide | artificial sequence | |
| primer | | 524 | Reverse primer used to amplify lacZ of *E. coli* and Sanger sequencing | nucleotide | artificial sequence | |
| primer | | 525 | Sanger sequencing of base edit of lacZ of *E. coli* | nucleotide | artificial sequence | |
| primer | | 526 | Sanger sequencing of base edit of lacZ of *E. coli* | nucleotide | artificial sequence | |
| primer | | 527 | Sanger sequencing of base edit of lacZ of *E. coli* | nucleotide | artificial sequence | |
| primer | | 528 | Sanger sequencing of base edit of lacZ of *E. coli* | nucleotide | artificial sequence | |
| primer | | 529 | Sanger sequencing of base edit of lacZ of *E. coli* | nucleotide | artificial sequence | |
| primer | | 530 | Sanger sequencing of base edit of lacZ of *E. coli* | nucleotide | artificial sequence | |
| primer | | 531 | Sanger sequencing of base edit of lacZ of *E. coli* | nucleotide | artificial sequence | |
| primer | | 532 | Forward primer used to amplify CAT (H193Y) of CAT (H193Y)-sgRNA-MG68-4 variant-nSpCas9 (D10A) | nucleotide | artificial sequence | |
| primer | | 533 | Reverse primer used to amplify CAT (H193Y) of CAT (H193Y)-sgRNA-MG68-4 variant-nSpCas9 | nucleotide | artificial sequence | |
| primer | | 534 | Forward primer used to amplify CAT (H193Y) of CAT (H193Y)-sgRNA-MG68-4 variant-nMG34-1 (D10A) | nucleotide | artificial sequence | |
| primer | | 535 | Sanger sequencing primer of CAT (H193Y) | nucleotide | artificial sequence | |
| primer | | 536 | Forward primer used to amplify BE3 target site in HEK293T cells and Sanger sequencing | nucleotide | artificial sequence | |
| primer | | 537 | Reverse primer used to amplify BE3 target site in HEK293T cells for Sanger sequencing | nucleotide | artificial sequence | |
| primer | | 538 | Forward primer used to amplify A0A2KSRDN7-nSpCas9 (D10A)-MG69-1 site 1 in HEK293T cells | nucleotide | artificial sequence | |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| primer | | 539 | Reverse primer used to amplify A0A2K5RDN7-nSpCas9 (D10A)-MG69-1_site 1 in HEK293T cells | nucleotide | artificial sequence | |
| primer | | 540 | Forward primer used to amplify A0A2K5RDN7-nSpCas9 (D10A)-MG69-1 site 2 in HEK293T cells | nucleotide | artificial sequence | |
| primer | | 541 | Reverse primer used to amplify A0A2K5RDN7-nSpCas9 (D10A)-MG69-1 site 2 in HEK293T cells | nucleotide | artificial sequence | |
| primer | | 542 | Forward primer used to amplify A0A2K5RDN7-nSpCas9 (D10A)-MG69-1 site 3 in HEK293T cells | nucleotide | artificial sequence | |
| primer | | 543 | Reverse primer used to amplify A0A2K5RDN7-nSpCas9 (D10A)-MG69-1 site 3 in HEK293T cells | nucleotide | artificial sequence | |
| primer | | 544 | Forward primer used to amplify A0A2K5RDN7-nSpCas9 (D10A)-MG69-1 site 4 in HEK293T cells | nucleotide | artificial sequence | |
| primer | | 545 | Reverse primer used to amplify A0A2KSRDN7-nSpCas9 (D10A)-MG69-1_site 4 in HEK293T cells | nucleotide | artificial sequence | |
| primer | | 546 | Forward primer used to amplify A0A2K5RDN7-nSpCas9 (D10A)-MG69-1_site 5 in HEK293T cells | nucleotide | artificial sequence | |
| primer | | 547 | Reverse primer used to amplify A0A2K5RDN7-nSpCas9 (D10A)-MG69-1_site 5 in HEK293T cells | nucleotide | artificial sequence | |
| primer | | 548 | Forward primer used to amplify A0A2K5RDN7-nMG1-4 (D9A)-MG69-1_site 1 in HEK293T cells | nucleotide | artificial sequence | |
| primer | | 549 | Reverse primer used to amplify A0A2K5RDN7-nMG1-4 (D9A)-MG69-1_site 1 in HEK293T cells | nucleotide | artificial sequence | |
| primer | | 550 | Forward primer used to amplify A0A2K5RDN7-nMG1-4 (D9A)-MG69-1_site 2 in HEK293T cells | nucleotide | artificial sequence | |
| primer | | 551 | Reverse primer used to amplify A0A2K5RDN7-nMG1-4 (D9A)-MG69-1_site 2 in HEK293T cells | nucleotide | artificial sequence | |
| primer | | 552 | Forward primer used to amplify A0A2K5RDN7-nMG1-4 (D9A)-MG69-1_site 3 in HEK293T cells | nucleotide | artificial sequence | |
| primer | | 553 | Reverse primer used to amplify A0A2K5RDN7-nMG1-4 (D9A)-MG69-1_site 3 in HEK293T cells | nucleotide | artificial sequence | |
| primer | | 554 | Forward primer used to amplify A0A2K5RDN7-nMG1-4 (D9A)-MG69-1_site 4 in HEK293T cells | nucleotide | artificial sequence | |
| primer | | 555 | Reverse primer used to amplify A0A2K5RDN7-nMG1-4 (D9A)-MG69-1_site 4 in HEK293T cells | nucleotide | artificial sequence | |
| primer | | 556 | Forward primer used to amplify A0A2K5RDN7-nMG3-6 (D13A)-MG69-1_site 1 in HEK293T cells | nucleotide | artificial sequence | |
| primer | | 557 | Reverse primer used to amplify A0A2K5RDN7-nMG3-6 (D13A)-MG69-1_site 1 in HEK293T cells | nucleotide | artificial sequence | |
| primer | | 558 | Forward primer used to amplify A0A2K5RDN7-nMG3-6 (D13A)-MG69-1_site 2 in HEK293T cells | nucleotide | artificial sequence | |
| primer | | 559 | Reverse primer used to amplify A0A2K5RDN7-nMG3-6 (D13A)-MG69-1_site 2 in HEK293T cells | nucleotide | artificial sequence | |
| primer | | 560 | Forward primer used to amplify A0A2K5RDN7-nMG3-6 (D13A)-MG69-1_site 3 in HEK293T cells | nucleotide | artificial sequence | |
| primer | | 561 | Reverse primer used to amplify A0A2K5RDN7-nMG3-6 (D13A)-MG69-1_site 3 in HEK293T cells | nucleotide | artificial sequence | |
| primer | | 562 | Forward primer used to amplify A0A2K5RDN7-nMG3-6 (D13A)-MG69-1_site 4 in HEK293T cells | nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| primer | | 563 | Reverse primer used to amplify A0A2K5RDN7-nMG3-6 (D13A)-MG69-1_site 4 in HEK293T cells | nucleotide | artificial sequence | |
| primer | | 564 | Forward primer used to amplify A0A2K5RDN7-nMG3-6 (D13A)-MG69-1_site 5 in HEK293T cells | nucleotide | artificial sequence | |
| primer | | 565 | Reverse primer used to amplify A0A2K5RDN7-nMG3-6 (D13A)-MG69-1_site 5 in HEK293T cells | nucleotide | artificial sequence | |
| primer | | 566 | Forward primer used to amplify A0A2K5RDN7-nMG3-6 (D13A)-MG69-1_site 6 in HEK293T cells | nucleotide | artificial sequence | |
| primer | | 567 | Reverse primer used to amplify A0A2K5RDN7-nMG3-6 (D13 A)-MG69-1_site 6 in HEK293T cells | nucleotide | artificial sequence | |
| primer | | 568 | Forward primer used to amplify A0A2K5RDN7-nMG3-6 (D13A)-MG69-1_site 7 in HEK293T cells | nucleotide | artificial sequence | |
| primer | | 569 | Reverse primer used to amplify A0A2K5RDN7-nMG3-6 (D13A)-MG69-1_site 7 in HEK293T cells | nucleotide | artificial sequence | |
| primer | | 570 | Forward primer used to amplify A0A2K5RDN7-nMG4-2 (D28A)-MG69-1_site 1 in HEK293T cells | nucleotide | artificial sequence | |
| primer | | 571 | Reverse primer used to amplify A0A2K5RDN7-nMG4-2 (D28A)-MG69-1_site 1 in HEK293T cells | nucleotide | artificial sequence | |
| primer | | 572 | Forward primer used to amplify A0A2K5RDN7-nMG4-2 (D28A)-MG69-1_site 2 in HEK293T cells | nucleotide | artificial sequence | |
| primer | | 573 | Reverse primer used to amplify A0A2K5RDN7-nMG4-2 (D28A)-MG69-1_site 2 in HEK293T cells | nucleotide | artificial sequence | |
| primer | | 574 | Forward primer used to amplify A0A2K5RDN7-nMG4-2 (D28A)-MG69-1_site 3 in HEK293T cells | nucleotide | artificial sequence | |
| primer | | 575 | Reverse primer used to amplify A0A2K5RDN7-nMG4-2 (D28A)-MG69-1_site 3 in HEK293T cells | nucleotide | artificial sequence | |
| primer | | 576 | Forward primer used to amplify A0A2K5RDN7-nMG4-2 (D28A)-MG69-1_site 4 in HEK293T cells | nucleotide | artificial sequence | |
| primer | | 577 | Reverse primer used to amplify A0A2K5RDN7-nMG4-2 (D28A)-MG69-1_site 4 in HEK293T cells | nucleotide | artificial sequence | |
| primer | | 578 | Forward primer used to amplify A0A2K5RDN7-nMG18-1 (D12A)-MG69-1_site 1 in HEK293T cells | nucleotide | artificial sequence | |
| primer | | 579 | Reverse primer used to amplify A0A2K5RDN7-nMG18-1 (D12A)-MG69-1_site 1 in HEK293T cells | nucleotide | artificial sequence | |
| primer | | 580 | Forward primer used to amplify A0A2K5RDN7-nMG18-1 (D12A)-MG69-1_site 2 in HEK293T cells | nucleotide | artificial sequence | |
| primer | | 581 | Reverse primer used to amplify A0A2K5RDN7-nMG18-1 (D12A)-MG69-1_site 2 in HEK293T cells | nucleotide | artificial sequence | |
| primer | | 582 | Forward primer used to amplify A0A2KSRDN7-nMG18-1 (D12A)-MG69-1_site 3 in HEK293T cells | nucleotide | artificial sequence | |
| primer | | 583 | Reverse primer used to amplify A0A2K5RDN7-nMG18-1 (D12A)-MG69-1_site 3 in HEK293T cells | nucleotide | artificial sequence | |
| primer | | 584 | Forward primer used to amplify A0A2K5RDN7-nMG18-1 (D12A)-MG69-1_site 4 in HEK293T cells | nucleotide | artificial sequence | |
| primer | | 585 | Reverse primer used to amplify A0A2K5RDN7-nMG18-1 (D12A)-MG69-1_site 4 in HEK293T cells | nucleotide | artificial sequence | |
| adenine base editor | | 586 | TadA (ABE8.17m)-nMG34-1 (D10A) | protein | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| cytosine base editor | | 587 | rAPOBEC1-nMG34-1 (D10A)-UGI (PBS1) | protein | artificial sequence | |
| adenine base editor | | 588 | MG68-3-nSpCas9 (D10A) | protein | artificial sequence | |
| adenine base editor | | 589 | MG68-8-nSpCas9 (D10A) | protein | artificial sequence | |
| Linker | | 590 | | protein | artificial sequence | |
| Linker | | 591 | | protein | artificial sequence | |
| Linker | | 592 | | protein | artificial sequence | |
| Linker | | 593 | | protein | artificial sequence | |
| Cytosine Deaminase | | 594 | CMP/dCMP-type deaminase domain-containing protein (uniprot accession A0A2K5RDN7) | protein | Cebus imitator | unknown |
| Adenosine Deaminase | | 595 | TadA* (ABE8.17m) | protein | unknown | unknown |
| MG34 active effectors | | 596 | MG34-1 effector | protein | unknown | uncultivated organism |
| nickase | | 597 | MG34-1 (D10A) | protein | unknown | uncultivated organism |
| PAM | A598 | | MG34-1 PAM | nucleotide | unknown | NGG |
| MG138 cytidine deaminase | | 599 | MG138-1 | protein | unknown | Aves Class |
| MG138 cytidine deaminase | | 600 | MG138-2 | protein | unknown | Aves Class |
| MG138 cytidine deaminase | | 601 | MG138-3 | protein | unknown | Aves Class |
| MG138 cytidine deaminase | | 602 | MG138-4 | protein | unknown | Aves Class |
| MG138 cytidine deaminase | | 603 | MG138-5 | protein | unknown | Aves Class |
| MG138 cytidine deaminase | | 604 | MG138-6 | protein | unknown | Aves Class |
| MG138 cytidine deaminase | | 605 | MG138-7 | protein | unknown | Aves Class |
| MG138 cytidine deaminase | | 606 | MG138-8 | protein | unknown | Aves Class |
| MG138 cytidine deaminase | | 607 | MG138-9 | protein | unknown | Aves Class |
| MG138 cytidine deaminase | | 608 | MG138-10 | protein | unknown | Aves Class |
| MG138 cytidine deaminase | | 609 | MG138-11 | protein | unknown | Aves Class |
| MG138 cytidine deaminase | | 610 | MG138-12 | protein | unknown | Aves Class |
| MG138 cytidine deaminase | | 611 | MG138-13 | protein | unknown | Aves Class |
| MG138 cytidine deaminase | | 612 | MG138-14 | protein | unknown | Aves Class |
| MG138 cytidine deaminase | | 613 | MG138-15 | protein | unknown | Aves Class |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG138 cytidine deaminase | | 614 | MG138-16 | protein | unknown | Aves Class |
| MG138 cytidine deaminase | | 615 | MG138-17 | protein | unknown | Aves Class |
| MG138 cytidine deaminase | | 616 | MG138-18 | protein | unknown | Aves Class |
| MG138 cytidine deaminase | | 617 | MG138-19 | protein | unknown | Aves Class |
| MG138 cytidine deaminase | | 618 | MG138-20 | protein | unknown | Aves Class |
| MG138 cytidine deaminase | | 619 | MG138-21 | protein | unknown | Aves Class |
| MG138 cytidine deaminase | | 620 | MG138-22 | protein | unknown | Aves Class |
| MG138 cytidine deaminase | | 621 | MG138-23 | protein | unknown | Aves Class |
| MG138 cytidine deaminase | | 622 | MG138-24 | protein | unknown | Aves Class |
| MG138 cytidine deaminase | | 623 | MG138-25 | protein | unknown | Aves Class |
| MG138 cytidine deaminase | | 624 | MG138-26 | protein | unknown | Aves Class |
| MG138 cytidine deaminase | | 625 | MG138-27 | protein | unknown | Aves Class |
| MG138 cytidine deaminase | | 626 | MG138-28 | protein | unknown | Aves Class |
| MG138 cytidine deaminase | | 627 | MG138-29 | protein | unknown | Aves Class |
| MG138 cytidine deaminase | | 628 | MG138-30 | protein | unknown | Aves Class |
| MG138 cytidine deaminase | | 629 | MG138-31 | protein | unknown | Aves Class |
| MG138 cytidine deaminase | | 630 | MG138-32 | protein | unknown | Aves Class |
| MG138 cytidine deaminase | | 631 | MG138-33 | protein | unknown | Aves Class |
| MG138 cytidine deaminase | | 632 | MG138-34 | protein | unknown | Aves Class |
| MG138 cytidine deaminase | | 633 | MG138-35 | protein | unknown | Aves Class |
| MG138 cytidine deaminase | | 634 | MG138-36 | protein | unknown | Aves Class |
| MG138 cytidine deaminase | | 635 | MG138-37 | protein | unknown | Aves Class |
| MG138 cytidine deaminase | | 636 | MG138-38 | protein | unknown | Aves Class |
| MG138 cytidine deaminase | | 637 | MG138-39 | protein | unknown | Aves Class |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG138 cytidine deaminase | | 638 | MG138-40 | protein | unknown | Aves Class |
| MG139 cytidine deaminase | | 639 | MG139-1 | protein | unknown | uncultivated organism |
| MG139 cytidine deaminase | | 640 | MG139-2 | protein | unknown | uncultivated organism |
| MG139 cytidine deaminase | | 641 | MG139-3 | protein | unknown | uncultivated organism |
| MG139 cytidine deaminase | | 642 | MG139-4 | protein | unknown | uncultivated organism |
| MG139 cytidine deaminase | | 643 | MG139-5 | protein | unknown | uncultivated organism |
| MG139 cytidine deaminase | | 644 | MG139-6 | protein | unknown | uncultivated organism |
| MG139 cytidine deaminase | | 645 | MG139-7 | protein | unknown | uncultivated organism |
| MG139 cytidine deaminase | | 646 | MG139-8 | protein | unknown | uncultivated organism |
| MG139 cytidine deaminase | | 647 | MG139-9 | protein | unknown | uncultivated organism |
| MG139 cytidine deaminase | | 648 | MG139-10 | protein | unknown | uncultivated organism |
| MG139 cytidine deaminase | | 649 | MG139-11 | protein | unknown | uncultivated organism |
| MG139 cytidine deaminase | | 650 | MG139-12 | protein | unknown | uncultivated organism |
| MG139 cytidine deaminase | | 651 | MG139-13 | protein | unknown | uncultivated organism |
| MG139 cytidine deaminase | | 652 | MG139-14 | protein | unknown | uncultivated organism |
| MG139 cytidine deaminase | | 653 | MG139-15 | protein | unknown | uncultivated organism |
| MG139 cytidine deaminase | | 654 | MG139-16 | protein | unknown | uncultivated organism |
| MG139 cytidine deaminase | | 655 | MG139-17 | protein | unknown | uncultivated organism |
| MG139 cytidine deaminase | | 656 | MG139-18 | protein | unknown | uncultivated organism |
| MG139 cytidine deaminase | | 657 | MG139-19 | protein | unknown | uncultivated organism |
| MG139 cytidine deaminase | | 658 | MG139-20 | protein | unknown | uncultivated organism |
| MG139 cytidine deaminase | | 659 | MG139-21 | protein | unknown | uncultivated organism |
| MG141 cytidine deaminase | | 660 | MG141-1 | protein | unknown | Aves class |
| MG141 cytidine deaminase | | 661 | MG141-2 | protein | unknown | Aves class |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG141 cytidine deaminase | | 662 | MG141-3 | protein | unknown | Aves class |
| MG142 cytidine deaminase | | 663 | MG142-1 | protein | unknown | Rodent class |
| MG142 cytidine deaminase | | 664 | MG142-2 | protein | unknown | Rodent class |
| MG93 cytidine deaminase | | 665 | MG93-1 | protein | unknown | Rodent class |
| MG93 cytidine deaminase | | 666 | MG93-2 | protein | unknown | Rodent class |
| MG93 cytidine deaminase | | 667 | MG93-3 | protein | unknown | Rodent class |
| MG93 cytidine deaminase | | 668 | MG93-4 | protein | unknown | Rodent class |
| MG93 cytidine deaminase | | 669 | MG93-5 | protein | unknown | Rodent class |
| MG93 cytidine deaminase | | 670 | MG93-6 | protein | unknown | Rodent class |
| MG93 cytidine deaminase | | 671 | MG93-7 | protein | unknown | Rodent class |
| MG93 cytidine deaminase | | 672 | MG93-8 | protein | unknown | Rodent class |
| MG93 cytidine deaminase | | 673 | MG93-9 | protein | unknown | Rodent class |
| MG93 cytidine deaminase | | 674 | MG93-10 | protein | unknown | Rodent class |
| MG93 cytidine deaminase | | 675 | MG93-11 | protein | unknown | Rodent class |
| adenine base editor | | 676 | MG68-4v1-nMG34-1 | Protein | artificial sequence | |
| adenine base editor | | 677 | TadA*(8.8m)-nMG34-1 | Protein | artificial sequence | |
| adenine base editor | | 678 | MG68-4v1-nSpCas9 | Protein | artificial sequence | |
| sgRNA scaffold sequence | | 679 | MG34-1 | nucleotide | artificial sequence | |
| sgRNA scaffold sequence | | 680 | SpCas9 | nucleotide | artificial sequence | |
| spacer | | 681 | Spacer targeting site 1 | nucleotide | artificial sequence | |
| spacer | | 682 | Spacer targeting site 2 | nucleotide | artificial sequence | |
| spacer | | 683 | Spacer targeting site 3 | nucleotide | artificial sequence | |
| spacer | | 684 | Spacer targeting site 4 | nucleotide | artificial sequence | |
| spacer | | 685 | Spacer targeting site 5 | nucleotide | artificial sequence | |
| spacer | | 686 | Spacer targeting site 6 | nucleotide | artificial sequence | |
| spacer | | 687 | Spacer targeting site 7 | nucleotide | artificial sequence | |
| spacer | | 688 | Spacer targeting site 8 | nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| spacer | | 689 | Spacer targeting site 9 | nucleotide | artificial sequence | |
| primer | | 690 | NGS primer for ABE site 1 | nucleotide | artificial sequence | |
| primer | | 691 | NGS primer for ABE site 1 | nucleotide | artificial sequence | |
| primer | | 692 | NGS primer for ABE site 2 | nucleotide | artificial sequence | |
| primer | | 693 | NGS primer for ABE site 2 | nucleotide | artificial sequence | |
| primer | | 694 | NGS primer for ABE site 3 | nucleotide | artificial sequence | |
| primer | | 695 | NGS primer for ABE site 3 | nucleotide | artificial sequence | |
| primer | | 696 | NGS primer for ABE site 4 | nucleotide | artificial sequence | |
| primer | | 697 | NGS primer for ABE site 4 | nucleotide | artificial sequence | |
| primer | | 698 | NGS primer for ABE site 5 | nucleotide | artificial sequence | |
| primer | | 699 | NGS primer for ABE site 5 | nucleotide | artificial sequence | |
| primer | | 700 | NGS primer for ABE site 6 | nucleotide | artificial sequence | |
| primer | | 701 | NGS primer for ABE site 6 | nucleotide | artificial sequence | |
| primer | | 702 | NGS primer for ABE site 7 | nucleotide | artificial sequence | |
| primer | | 703 | NGS primer for ABE site 7 | nucleotide | artificial sequence | |
| primer | | 704 | NGS primer for ABE site 8 | nucleotide | artificial sequence | |
| primer | | 705 | NGS primer for ABE site 8 | nucleotide | artificial sequence | |
| primer | | 706 | NGS primer for ABE site 9 | nucleotide | artificial sequence | |
| primer | | 707 | NGS primer for ABE site 9 | nucleotide | artificial sequence | |
| BSD resistance casette | | 708 | Blasticidin engineered sequence for selection purposes | nucleotide | artificial sequence | |
| spacer | | 709 | Spacer_MG3-6_g5 | nucleotide | artificial sequence | |
| spacer | | 710 | Spacer_MG3-6_g4 | nucleotide | artificial sequence | |
| spacer | | 711 | Spacer_MG3-6_g3 | nucleotide | artificial sequence | |
| spacer | | 712 | Spacer_MG3-6_g2 | nucleotide | artificial sequence | |
| spacer | | 713 | Spacer_MG3-6_g1 | nucleotide | artificial sequence | |
| spacer | | 714 | Spacer_Cas9_g6 | nucleotide | artificial sequence | |
| spacer | | 715 | Spacer_Cas9_g5 | nucleotide | artificial sequence | |
| spacer | | 716 | Spacer_Cas9_g4 | nucleotide | artificial sequence | |
| spacer | | 717 | Spacer_Cas9_g3 | nucleotide | artificial sequence | |
| spacer | | 718 | Spacer_Cas9_g2 | nucleotide | artificial sequence | |
| spacer | | 719 | Spacer_Cas9_g1 | nucleotide | artificial sequence | |
| plasmid | | 720 | pCMV | nucleotide | artificial sequence | |
| plasmid | | 721 | pCMV-MG68-4v1-nMG34-1 | nucleotide | artificial sequence | |
| plasmid | | 722 | pCMV-TadA*(8.8m)-nMG34-1 | nucleotide | artificial sequence | |
| plasmid | | 723 | pCMV-MG68-4v1-nSpCas9 | nucleotide | artificial sequence | |
| plasmid | | 724 | pCMV-MG68-4v1-nMG34-1_sgRNA 1 | nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| plasmid | | 725 | pCMV-TadA*(8.8m)-nMG34-1_sgRNA 1 | nucleotide | artificial sequence | |
| plasmid | | 726 | pCMV-MG68-4v1-nSpCas9_sgRNA 1 | nucleotide | artificial sequence | |
| adenine base editor | | 727 | TadA*(8.17m)-nMG34-1 | Protein | artificial sequence | |
| adenine base editor | | 728 | TadA*(8.17m)-nSpCas9 | Protein | artificial sequence | |
| spacer | | 729 | Spacer 1 for TadA*(8.17m)-nMG34-1 targeting in *E. coli* | nucleotide | artificial sequence | |
| spacer | | 730 | Spacer 2 for TadA*(8.17m)-nMG34-1 targeting in *E. coli* | nucleotide | artificial sequence | |
| spacer | | 731 | Spacer 3 for TadA*(8.17m)-nMG34-1 targeting in *E. coli* | nucleotide | artificial sequence | |
| spacer | | 732 | Spacer 4 for TadA*(8.17m)-nMG34-1 targeting in *E. coli* | nucleotide | artificial sequence | |
| spacer | | 733 | Spacer 1 for TadA*(8.17m)-nSpCas9 targeting in *E. coli* | nucleotide | artificial sequence | |
| spacer | | 734 | Spacer 2 for TadA*(8.17m)-nSpCas9 targeting in *E. coli* | nucleotide | artificial sequence | |
| spacer | | 735 | Spacer 3 for TadA*(8.17m)-nSpCas9 targeting in *E. coli* | nucleotide | artificial sequence | |
| spacer | | 736 | Spacer 4 for TadA*(8.17m)-nSpCas9 targeting in *E. coli* | nucleotide | artificial sequence | |
| plasmid | | 737 | pCMV-TadA*(8.17m)-nMG34-1_sgRNA 1 | nucleotide | artificial sequence | |
| plasmid | | 738 | pCMV-TadA*(8.17m)-nSpCas9_sgRNA 1 | nucleotide | artificial sequence | |
| cytidine base editor | | 739 | rAPOBEC1-nMG34-1-UGI (PBS) | Protein | artificial sequence | |
| cytidine base editor | | 740 | rAPOBEC1-nSpCas9-UGI (PBS) | Protein | artificial sequence | |
| plasmid | | 741 | plasmid, prepared by Twist, that contains the A1CF gene, a cofactor for APOBEC activity on RNA | nucleotide | human | |
| oligonucl eotide | | 742 | RNA Sequence used to test CDAs for RNA activity. From Wolfe et. al. NAR Cancer, 2020, Vol. 2, No. 4 | nucleotide | | |
| oligonucl eotide | | 743 | Labelled primer for poisoned primer extension assay used to test CDAs for RNA activity. From Wolfe et. al. NAR Cancer, 2020, Vol. 2, No. 4. 5' FAM Label | nucleotide | | |
| MG139 cytidine deaminase | | 744 | MG139-22 | Protein | Unknown | uncultivated organism |
| MG139 cytidine deaminase | | 745 | MG139-23 | Protein | Unknown | uncultivated organism |
| MG139 cytidine deaminase | | 746 | MG139-24 | Protein | Unknown | uncultivated organism |
| MG139 cytidine deaminase | | 747 | MG139-25 | Protein | Unknown | uncultivated organism |
| MG139 cytidine deaminase | | 748 | MG139-26 | Protein | Unknown | uncultivated organism |
| MG139 cytidine deaminase | | 749 | MG139-27 | Protein | Unknown | uncultivated organism |
| MG139 cytidine deaminase | | 750 | MG139-28 | Protein | Unknown | uncultivated organism |
| MG139 cytidine deaminase | | 751 | MG139-29 | Protein | Unknown | uncultivated organism |
| MG139 cytidine deaminase | | 752 | MG139-30 | Protein | Unknown | uncultivated organism |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG139 cytidine deaminase | | 753 | MG139-31 | Protein | Unknown | uncultivated organism |
| MG139 cytidine deaminase | | 754 | MG139-32 | Protein | Unknown | uncultivated organism |
| MG139 cytidine deaminase | | 755 | MG139-33 | Protein | Unknown | uncultivated organism |
| MG139 cytidine deaminase | | 756 | MG139-34 | Protein | Unknown | uncultivated organism |
| MG139 cytidine deaminase | | 757 | MG139-35 | Protein | Unknown | uncultivated organism |
| MG139 cytidine deaminase | | 758 | MG139-36 | Protein | Unknown | uncultivated organism |
| MG139 cytidine deaminase | | 759 | MG139-37 | Protein | Unknown | uncultivated organism |
| MG139 cytidine deaminase | | 760 | MG139-38 | Protein | Unknown | uncultivated organism |
| MG139 cytidine deaminase | | 761 | MG139-39 | Protein | Unknown | uncultivated organism |
| MG139 cytidine deaminase | | 762 | MG139-40 | Protein | Unknown | uncultivated organism |
| MG139 cytidine deaminase | | 763 | MG139-41 | Protein | Unknown | uncultivated organism |
| MG139 cytidine deaminase | | 764 | MG139-42 | Protein | Unknown | uncultivated organism |
| MG139 cytidine deaminase | | 765 | MG139-43 | Protein | Unknown | uncultivated organism |
| MG139 cytidine deaminase | | 766 | MG139-44 | Protein | Unknown | uncultivated organism |
| MG139 cytidine deaminase | | 767 | MG139-45 | Protein | Unknown | uncultivated organism |
| MG139 cytidine deaminase | | 768 | MG139-46 | Protein | Unknown | uncultivated organism |
| MG139 cytidine deaminase | | 769 | MG139-47 | Protein | Unknown | uncultivated organism |
| MG139 cytidine deaminase | | 770 | MG139-48 | Protein | Unknown | uncultivated organism |
| MG139 cytidine deaminase | | 771 | MG139-49 | Protein | Unknown | uncultivated organism |
| MG139 cytidine deaminase | | 772 | MG139-50 | Protein | Unknown | uncultivated organism |
| MG139 cytidine deaminase | | 773 | MG139-51 | Protein | Unknown | uncultivated organism |
| MG139 cytidine deaminase | | 774 | MG139-52 | Protein | Unknown | uncultivated organism |
| MG139 cytidine deaminase | | 775 | MG139-53 | Protein | Unknown | uncultivated organism |
| MG139 cytidine deaminase | | 776 | MG139-54 | Protein | Unknown | uncultivated organism |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG139 cytidine deaminase | | 777 | MG139-55 | Protein | Unknown | uncultivated organism |
| MG139 cytidine deaminase | | 778 | MG139-56 | Protein | Unknown | uncultivated organism |
| MG139 cytidine deaminase | | 779 | MG139-57 | Protein | Unknown | uncultivated organism |
| MG139 cytidine deaminase | | 780 | MG139-58 | Protein | Unknown | uncultivated organism |
| MG139 cytidine deaminase | | 781 | MG139-59 | Protein | Unknown | uncultivated organism |
| MG139 cytidine deaminase | | 782 | MG139-60 | Protein | Unknown | uncultivated organism |
| MG139 cytidine deaminase | | 783 | MG139-61 | Protein | Unknown | uncultivated organism |
| MG139 cytidine deaminase | | 784 | MG139-62 | Protein | Unknown | uncultivated organism |
| MG139 cytidine deaminase | | 785 | MG139-63 | Protein | Unknown | uncultivated organism |
| MG139 cytidine deaminase | | 786 | MG139-64 | Protein | Unknown | uncultivated organism |
| MG139 cytidine deaminase | | 787 | MG139-65 | Protein | Unknown | uncultivated organism |
| MG139 cytidine deaminase | | 788 | MG139-66 | Protein | Unknown | uncultivated organism |
| MG139 cytidine deaminase | | 789 | MG139-67 | Protein | Unknown | uncultivated organism |
| MG139 cytidine deaminase | | 790 | MG139-68 | Protein | Unknown | uncultivated organism |
| MG139 cytidine deaminase | | 791 | MG139-69 | Protein | Unknown | uncultivated organism |
| MG139 cytidine deaminase | | 792 | MG139-70 | Protein | Unknown | uncultivated organism |
| MG139 cytidine deaminase | | 793 | MG139-71 | Protein | Unknown | uncultivated organism |
| MG139 cytidine deaminase | | 794 | MG139-72 | Protein | Unknown | uncultivated organism |
| MG139 cytidine deaminase | | 79 | MG139-73 | Protein | Unknown | uncultivated organism |
| MG139 cytidine deaminase | | 796 | MG139-74-1 | Protein | Unknown | uncultivated organism |
| MG139 cytidine deaminase | | 797 | MG139-74-2 | Protein | Unknown | uncultivated organism |
| MG139 cytidine deaminase | | 798 | MG139-75 | Protein | Unknown | uncultivated organism |
| MG139 cytidine deaminase | | 799 | MG139-76 | Protein | Unknown | uncultivated organism |
| MG139 cytidine deaminase | | 800 | MG139-77-1 | Protein | Unknown | uncultivated organism |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG139 cytidine deaminase | | 801 | MG139-77-2 | Protein | Unknown | uncultivated organism |
| MG139 cytidine deaminase | | 802 | MG139-78 | Protein | Unknown | uncultivated organism |
| MG139 cytidine deaminase | | 803 | MG139-79 | Protein | Unknown | uncultivated organism |
| MG139 cytidine deaminase | | 804 | MG139-80 | Protein | Unknown | uncultivated organism |
| MG139 cytidine deaminase | | 805 | MG139-81 | Protein | Unknown | uncultivated organism |
| MG139 cytidine deaminase | | 806 | MG139-82 | Protein | Unknown | uncultivated organism |
| MG139 cytidine deaminase | | 807 | MG139-83 | Protein | Unknown | uncultivated organism |
| MG139 cytidine deaminase | | 808 | MG139-84 | Protein | Unknown | uncultivated organism |
| MG139 cytidine deaminase | | 809 | MG139-85 | Protein | Unknown | uncultivated organism |
| MG139 cytidine deaminase | | 810 | MG139-86 | Protein | Unknown | uncultivated organism |
| MG139 cytidine deaminase | | 811 | MG139-87 | Protein | Unknown | uncultivated organism |
| MG139 cytidine deaminase | | 812 | MG139-88 | Protein | Unknown | uncultivated organism |
| MG139 cytidine deaminase | | 813 | MG139-89 | Protein | Unknown | uncultivated organism |
| MG139 cytidine deaminase | | 814 | MG139-90 | Protein | Unknown | uncultivated organism |
| MG139 cytidine deaminase | | 815 | MG139-91 | Protein | Unknown | uncultivated organism |
| MG139 cytidine deaminase | | 816 | MG139-92 | Protein | Unknown | uncultivated organism |
| MG139 cytidine deaminase | | 817 | MG139-93 | Protein | Unknown | uncultivated organism |
| MG139 cytidine deaminase | | 818 | MG139-94 | Protein | Unknown | uncultivated organism |
| MG139 cytidine deaminase | | 819 | MG139-95 | Protein | Unknown | uncultivated organism |
| MG139 cytidine deaminase | | 820 | MG139-96 | Protein | Unknown | uncultivated organism |
| MG139 cytidine deaminase | | 821 | MG139-97 | Protein | Unknown | uncultivated organism |
| MG139 cytidine deaminase | | 822 | MG139-98 | Protein | Unknown | uncultivated organism |
| MG139 cytidine deaminase | | 823 | MG139-99 | Protein | Unknown | uncultivated organism |
| MG139 cytidine deaminase | | 824 | MG139-100 | Protein | Unknown | uncultivated organism |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG139 cytidine deaminase | | 825 | MG139-101 | Protein | Unknown | uncultivated organism |
| MG139 cytidine deaminase | | 826 | MG139-102 | Protein | Unknown | uncultivated organism |
| MG139 cytidine deaminase | | 827 | MG139-103 | Protein | Unknown | uncultivated organism |
| MG93 cytidine deaminase | | 828 | MG93-12 | Protein | Unknown | Rodent class |
| MG142 Cytidine deaminase | | 829 | MG142-3 | Protein | Unknown | Rodent class |
| MG152 cytidine deaminase | | 830 | MG152-1 | Protein | Unknown | Bivalvia class |
| MG152 cytidine deaminase | | 831 | MG152-2 | Protein | Unknown | Bivalvia class |
| MG152 cytidine deaminase | | 832 | MG152-3 | Protein | Unknown | Bivalvia class |
| MG152 cytidine deaminase | | 833 | MG152-4 | Protein | Unknown | Bivalvia class |
| MG152 cytidine deaminase | | 834 | MG152-5 | Protein | Unknown | Bivalvia class |
| MG152 cytidine deaminase | | 835 | MG152-6 | Protein | Unknown | Bivalvia class |
| adenine base editor | | 836 | MG68-4_r1v1_nMG34-1 | Protein | Artificial sequence | |
| adenine base editor | | 837 | MG68-4_r2v1_nMG34-1 | Protein | Artificial sequence | |
| adenine base editor | | 838 | MG68-4_r2v2_nMG34-1 | Protein | Artificial sequence | |
| adenine base editor | | 839 | MG68-4_r2v3_nMG34-1 | Protein | Artificial sequence | |
| adenine base editor | | 840 | MG68-4_r2v4_nMG34-1 | Protein | Artificial sequence | |
| adenine base editor | | 841 | MG68-4_r2v5_nMG34-1 | Protein | Artificial sequence | |
| adenine base editor | | 842 | MG68-4_r2v6_nMG34-1 | Protein | Artificial sequence | |
| adenine base editor | | 843 | MG68-4_r2v7_nMG34-1 | Protein | Artificial sequence | |
| adenine base editor | | 844 | MG68-4_r2v8_nMG34-1 | Protein | Artificial sequence | |
| adenine base editor | | 845 | MG68-4_r2v9_nMG34-1 | Protein | Artificial sequence | |
| adenine base editor | | 846 | MG68-4_r2v10_nMG34-1 | Protein | Artificial sequence | |
| adenine base editor | | 847 | MG68-4_r2v11_nMG34-1 | Protein | Artificial sequence | |
| adenine base editor | | 848 | MG68-4_r2v12_nMG34-1 | Protein | Artificial sequence | |

TABLE 2-continued

| Category | Sequence Number | SEQ ID NO: | Description | Type | Organism | Other Information or Sequence |
|---|---|---|---|---|---|---|
| Sequence Listing of Protein and Nucleic Acid Sequences Referred to Herein | | | | | | |
| adenine base editor | | 849 | MG68-4_r2v13_nMG34-1 | Protein | Artificial sequence | |
| adenine base editor | | 850 | MG68-4_r2v14_nMG34-1 | Protein | Artificial sequence | |
| adenine base editor | | 851 | MG68-4_r2v15_nMG34-1 | Protein | Artificial sequence | |
| adenine base editor | | 852 | MG68-4_r2v16_nMG34-1 | Protein | Artificial sequence | |
| adenine base editor | | 853 | MG68-4_r2v17_nMG34-1 | Protein | Artificial sequence | |
| adenine base editor | | 854 | MG68-4_r2v18_nMG34-1 | Protein | Artificial sequence | |
| adenine base editor | | 855 | MG68-4_r2v19_nMG34-1 | Protein | Artificial sequence | |
| adenine base editor | | 856 | MG68-4_r2v20_nMG34-1 | Protein | Artificial sequence | |
| adenine base editor | | 857 | MG68-4_r2v21_nMG34-1 | Protein | Artificial sequence | |
| adenine base editor | | 858 | MG68-4_r2v22_nMG34-1 | Protein | Artificial sequence | |
| adenine base editor | | 859 | MG68-4_r2v23_nMG34-1 | Protein | Artificial sequence | |
| adenine base editor | | 860 | MG68-4_r2v24_nMG34-1 | Protein | Artificial sequence | |
| spacer | | 861 | guide 1 for ABE using MG34-1 | nucleotide | Artificial sequence | |
| spacer | | 862 | guide 2 for ABE using MG34-1 | nucleotide | Artificial sequence | |
| spacer | | 863 | guide 3 for ABE using MG34-1 | nucleotide | Artificial sequence | |
| spacer | | 864 | guide 4 for ABE using MG34-1 | nucleotide | Artificial sequence | |
| primer | | 865 | NGS primer for guide 1 of ABE using MG34-1 | nucleotide | Artificial sequence | |
| primer | | 866 | NGS primer for guide 1 of ABE using MG34-1 | nucleotide | Artificial sequence | |
| primer | | 867 | NGS primer for guide 2 of ABE using MG34-1 | nucleotide | Artificial sequence | |
| primer | | 868 | NGS primer for guide 2 of ABE using MG34-1 | nucleotide | Artificial sequence | |
| primer | | 869 | NGS primer for guide 3 of ABE using MG34-1 | nucleotide | Artificial sequence | |
| primer | | 870 | NGS primer for guide 3 of ABE using MG34-1 | nucleotide | Artificial sequence | |
| primer | | 871 | NGS primer for guide 4 of ABE using MG34-1 | nucleotide | Artificial sequence | |
| primer | | 872 | NGS primer for guide 4 of ABE using MG34-1 | nucleotide | Artificial sequence | |
| Plasmid | | 873 | pCMV-MG68-4_rlv1_nMG34-1 | nucleotide | Artificial sequence | |
| Plasmid | | 874 | pCMV-U6p-spacer (guide 1)-MG34-1 sgRNA scaffold | nucleotide | Artificial sequence | |
| Plasmid | | 875 | pAL478 | nucleotide | Artificial sequence | |
| sgRNA scaffold sequence | | 876 | MG34-1 | nucleotide | artificial sequence | |
| Cytosine Base Editor | | 877 | spCAS9 + MG139-12 + MG69-1 | Protein | Artificial sequence | |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| Cytosine Base Editor | | 878 | spCAS9 + MG93-4 + MG69-1 | Protein | Artificial sequence | |
| Cytosine Base Editor | | 879 | spCAS9 + MG93-3 + MG69-1 | Protein | Artificial sequence | |
| Cytosine Base Editor | | 880 | spCAS9 + MG93-5 + MG69-1 | Protein | Artificial sequence | |
| Cytosine Base Editor | | 881 | spCAS9 + MG93-6 + MG69-1 | Protein | Artificial sequence | |
| Cytosine Base Editor | | 882 | spCAS9 + MG93-7 + MG69-1 | Protein | Artificial sequence | |
| Cytosine Base Editor | | 883 | spCAS9 + MG93-9 + MG69-1 | Protein | Artificial sequence | |
| Cytosine Base Editor | | 884 | spCAS9 + MG93-11 + MG69-1 | Protein | Artificial sequence | |
| Cytosine Base Editor | | 885 | spCAS9 + MG138-17 + MG69-1 | Protein | Artificial sequence | |
| Cytosine Base Editor | | 886 | spCAS9 + MG138-20 + MG69-1 | Protein | Artificial sequence | |
| Cytosine Base Editor | | 887 | spCAS9 + MG138-23 + MG69-1 | Protein | Artificial sequence | |
| Cytosine Base Editor | | 888 | spCAS9 + MG138-32 + MG69-1 | Protein | Artificial sequence | |
| Cytosine Base Editor | | 889 | spCAS9 + MG142-1 + MG69-1 | Protein | Artificial sequence | |
| Cytosine Base Editor | | 890 | MG3-6 + MG139-12 + MG69-1 | Protein | Artificial sequence | |
| Cytosine Base Editor | | 891 | MG3-6 + MG93-4 + MG69-1 | Protein | Artificial sequence | |
| Cytosine Base Editor | | 892 | MG3-6 + MG93-3 + MG69-1 | Protein | Artificial sequence | |
| Cytosine Base Editor | | 893 | MG3-6 + MG93-5 + MG69-1 | Protein | Artificial sequence | |
| Cytosine Base Editor | | 894 | MG3-6 + MG93-6 + MG69-1 | Protein | Artificial sequence | |
| Cytosine Base Editor | | 895 | MG3-6 + MG93-7 + MG69-1 | Protein | Artificial sequence | |
| Cytosine Base Editor | | 896 | MG3-6 + MG93-9 + MG69-1 | Protein | Artificial sequence | |
| Cytosine Base Editor | | 897 | MG3-6 + MG93-11 + MG69-1 | Protein | Artificial sequence | |
| Cytosine Base Editor | | 898 | MG3-6 + MG138-17 + MG69-1 | Protein | Artificial sequence | |
| Cytosine Base Editor | | 899 | MG3-6 + MG138-20 + MG69-1 | Protein | Artificial sequence | |
| Cytosine Base Editor | | 900 | MG3-6 + MG138-23 + MG69-1 | Protein | Artificial sequence | |
| Cytosine Base Editor | | 901 | MG3-6 + MG138-32 + MG69-1 | Protein | Artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| Cytosine Base Editor | | 902 | MG3-6 + MG142-1 + MG69-1 | Protein | Artificial sequence | |
| Cytosine Base Editor | | 903 | MG34-1 + MG139-12 + MG69-1 | Protein | Artificial sequence | |
| Cytosine Base Editor | | 904 | MG34-1 + MG93-4 + MG69-1 | Protein | Artificial sequence | |
| Cytosine Base Editor | | 905 | MG34-1 + MG93-3 + MG69-1 | Protein | Artificial sequence | |
| Cytosine Base Editor | | 906 | MG34-1 + MG93-5 + MG69-1 | Protein | Artificial sequence | |
| Cytosine Base Editor | | 907 | MG34-1 + MG93-6 + MG69-1 | Protein | Artificial sequence | |
| Cytosine Base Editor | | 908 | MG34-1 + MG93-7 + MG69-1 | Protein | Artificial sequence | |
| Cytosine Base Editor | | 909 | MG34-1 + MG93-9 + MG69-1 | Protein | Artificial sequence | |
| Cytosine Base Editor | | 910 | MG34-1 + MG93-11 + MG69-1 | Protein | Artificial sequence | |
| Cytosine Base Editor | | 911 | MG34-1 + MG138-17 + MG69-1 | Protein | Artificial sequence | |
| Cytosine Base Editor | | 912 | MG34-1 + MG138-20 + MG69-1 | Protein | Artificial sequence | |
| Cytosine Base Editor | | 913 | MG34-1 + MG138-23 + MG69-1 | Protein | Artificial sequence | |
| Cytosine Base Editor | | 914 | MG34-1 + MG138-32 + MG69-1 | Protein | Artificial sequence | |
| Cytosine Base Editor | | 915 | MG34-1 + MG142-1 + MG69-1 | Protein | Artificial sequence | |
| Cytosine Base Editor | | 916 | MG34-1 + A0A2K5RDN7(APOBEC 3A) + MG69-1 | Protein | Artificial sequence | |
| sgRNA (spacer and scaffold) | | 917 | sgRNA266 | nucleotide | Artificial sequence | |
| sgRNA (spacer and scaffold) | | 918 | sgRNA691 | nucleotide | Artificial sequence | |
| sgRNA (spacer and scaffold) | | 919 | sgRNA692 | nucleotide | Artificial sequence | |
| sgRNA (spacer scaffold) | | 920 | sgRNA693 | nucleotide | Artificial sequence | |
| sgRNA (spacer and scaffold) | | 921 | sgRNA694 | nucleotide | Artificial sequence | |
| sgRNA (spacer and scaffold) | | 922 | sgRNA708 | nucleotide | Artificial sequence | |
| sgRNA (spacer and scaffold) | | 923 | sgRNA709 | nucleotide | Artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| sgRNA (spacer and scaffold) | | 924 | sgRNA710 | nucleotide | Artificial sequence | |
| sgRNA (spacer and scaffold) | | 925 | sgRNA711 | nucleotide | Artificial sequence | |
| sgRNA (spacer and scaffold) | | 926 | sgRNA712 | nucleotide | Artificial sequence | |
| sgRNA (spacer and scaffold) | | 927 | sgRNA633 | nucleotide | Artificial sequence | |
| sgRNA (spacer and scaffold) | | 928 | sgRNA634 | nucleotide | Artificial sequence | |
| sgRNA (spacer and scaffold) | | 929 | sgRNA635 | nucleotide | Artificial sequence | |
| sgRNA (spacer and scaffold) | | 930 | sgRNA636 | nucleotide | Artificial sequence | |
| sgRNA (spacer and scaffold) | | 931 | sgRNA641 | nucleotide | Artificial sequence | |
| primer | | 932 | NGS primer for sgRNA266 | nucleotide | Artificial sequence | |
| primer | | 933 | NGS primer for sgRNA266 | nucleotide | Artificial sequence | |
| primer | | 934 | NGS primer for sgRNA691 | nucleotide | Artificial sequence | |
| primer | | 935 | NGS primer for sgRNA691 | nucleotide | Artificial sequence | |
| primer | | 936 | NGS primer for sgRNA692 | nucleotide | Artificial sequence | |
| primer | | 937 | NGS primer for sgRNA692 | nucleotide | Artificial sequence | |
| primer | | 938 | NGS primer for sgRNA693 | nucleotide | Artificial sequence | |
| primer | | 939 | NGS primer for sgRNA693 | nucleotide | Artificial sequence | |
| primer | | 940 | NGS primer for sgRNA694 | nucleotide | Artificial sequence | |
| primer | | 941 | NGS primer for sgRNA694 | nucleotide | Artificial sequence | |
| primer | | 942 | NGS primer for sgRNA708 | nucleotide | Artificial sequence | |
| primer | | 943 | NGS primer for sgRNA708 | nucleotide | Artificial sequence | |
| primer | | 944 | NGS primer for sgRNA709 | nucleotide | Artificial sequence | |
| primer | | 945 | NGS primer for sgRNA709 | nucleotide | Artificial sequence | |
| primer | | 946 | NGS primer for sgRNA710 | nucleotide | Artificial sequence | |
| primer | | 947 | NGS primer for sgRNA710 | nucleotide | Artificial sequence | |
| primer | | 948 | NGS primer for sgRNA711 | nucleotide | Artificial sequence | |
| primer | | 949 | NGS primer for sgRNA711 | nucleotide | Artificial sequence | |
| primer | | 950 | NGS primer for sgRNA712 | nucleotide | Artificial sequence | |
| primer | | 951 | NGS primer for sgRNA712 | nucleotide | Artificial sequence | |
| primer | | 952 | NGS primer for sgRNA633 | nucleotide | Artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| primer | | 953 | NGS primer for sgRNA633 | nucleotide | Artificial sequence | |
| primer | | 954 | NGS primer for sgRNA634 | nucleotide | Artificial sequence | |
| primer | | 955 | NGS primer for sgRNA634 | nucleotide | Artificial sequence | |
| primer | | 956 | NGS primer for sgRNA635 | nucleotide | Artificial sequence | |
| primer | | 957 | NGS primer for sgRNA635 | nucleotide | Artificial sequence | |
| primer | | 958 | NGS primer for sgRNA636 | nucleotide | Artificial sequence | |
| primer | | 959 | NGS primer for sgRNA636 | nucleotide | Artificial sequence | |
| primer | | 960 | NGS primer for sgRNA641 | nucleotide | Artificial sequence | |
| primer | | 961 | NGS primer for sgRNA641 | nucleotide | Artificial sequence | |
| Engineered sequence in mammalian cells | | 962 | Site enginereed in mammalian cell line with 5 PAMs compatible with Cas9 and MG3-6 editing | nucleotide | Artificial sequence | |
| sgRNA | | 963 | Spacer targeting engineered site #1 | nucleotide | Artificial sequence | |
| sgRNA | | 964 | Spacer targeting engineered site #2 | nucleotide | Artificial sequence | |
| sgRNA | | 965 | Spacer targeting engineered site #3 | nucleotide | Artificial sequence | |
| sgRNA | | 966 | Spacer targeting engineered site #4 | nucleotide | Artificial sequence | |
| sgRNA | | 967 | Spacer targeting engineered site #5 | nucleotide | Artificial sequence | |
| Cytosine Base Editor | | 968 | spCas9 + A0A2K5RDN7(APOBEC 3A) + MG69-1 | Protein | Artificial sequence | |
| Cytosine Base Editor | | 969 | MG3-6 + A0A2K5RDN7(APOBEC 3A) + MG69-1 | Protein | Artificial sequence | |
| MG139 cytidine deaminase | | 970 | MG139-12 | Protein | Unknown | uncultivated organism |
| MG93 cytidine deaminase | | 971 | MG93-3 | Protein | Unknown | uncultivated organism |
| MG93 cytidine deaminase | | 972 | MG93-4 | Protein | Unknown | uncultivated organism |
| MG93 cytidine deaminase | | 973 | MG93-5 | Protein | Unknown | uncultivated organism |
| MG93 cytidine deaminase | | 974 | MG93-6 | Protein | Unknown | uncultivated organism |
| MG93 cytidine deaminase | | 975 | MG93-7 | Protein | Unknown | uncultivated organism |
| MG93 cytidine deaminase | | 976 | MG93-9 | Protein | Unknown | uncultivated organism |
| MG93 cytidine deaminase | | 977 | MG93-11 | Protein | Unknown | uncultivated organism |
| MG138 cytidine deaminase | | 978 | MG138-17 | Protein | Unknown | uncultivated organism |
| MG138 cytidine deaminase | | 979 | MG138-20 | Protein | Unknown | uncultivated organism |
| MG138 cytidine deaminase | | 980 | MG138-23 | Protein | Unknown | uncultivated organism |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG138 cytidine deaminase | | 981 | MG138-32 | Protein | Unknown | uncultivated organism |
| MG142 cytidine deaminase | | 982 | MG142-1 | Protein | Unknown | uncultivated organism |
| MG128 Deaminase | | 983 | MG128-1 Deaminase | Protein | Unknown | Uncultivated Organism |
| MG128 Deaminase | | 984 | MG128-2 Deaminase | Protein | Unknown | Uncultivated Organism |
| MG128 Deaminase | | 985 | MG128-3 Deaminase | Protein | Unknown | Uncultivated Organism |
| MG128 Deaminase | | 986 | MG128-4 Deaminase | Protein | Unknown | Uncultivated Organism |
| MG128 Deaminase | | 987 | MG128-5 Deaminase | Protein | Unknown | Uncultivated Organism |
| MG128 Deaminase | | 988 | MG128-6 Deaminase | Protein | Unknown | Uncultivated Organism |
| MG128 Deaminase | | 989 | MG128-7 Deaminase | Protein | Unknown | Uncultivated Organism |
| MG128 Deaminase | | 990 | MG128-8 Deaminase | Protein | Unknown | Uncultivated Organism |
| MG128 Deaminase | | 991 | MG128-9 Deaminase | Protein | Unknown | Uncultivated Organism |
| MG128 Deaminase | | 992 | MG128-10 Deaminase | Protein | Unknown | Uncultivated Organism |
| MG128 Deaminase | | 993 | MG128-11 Deaminase | Protein | Unknown | Uncultivated Organism |
| MG128 Deaminase | | 994 | MG128-12 Deaminase | Protein | Unknown | Uncultivated Organism |
| MG128 Deaminase | | 995 | MG128-13 Deaminase | Protein | Unknown | Uncultivated Organism |
| MG128 Deaminase | | 996 | MG128-14 Deaminase | Protein | Unknown | Uncultivated Organism |
| MG128 Deaminase | | 997 | MG128-15 Deaminase | Protein | Unknown | Uncultivated Organism |
| MG128 Deaminase | | 998 | MG128-16 Deaminase | Protein | Unknown | Uncultivated Organism |
| MG128 Deaminase | | 999 | MG128-17 Deaminase | Protein | Unknown | Uncultivated Organism |
| MG128 Deaminase | | 1000 | MG128-18 Deaminase | Protein | Unknown | Uncultivated Organism |
| MG128 Deaminase | | 1001 | MG128-19 Deaminase | Protein | Unknown | Uncultivated Organism |
| MG128 Deaminase | | 1002 | MG128-20 Deaminase | Protein | Unknown | Uncultivated Organism |
| MG128 Deaminase | | 1003 | MG128-21 Deaminase | Protein | Unknown | Uncultivated Organism |
| MG128 Deaminase | | 1004 | MG128-22 Deaminase | Protein | Unknown | Uncultivated Organism |
| MG128 Deaminase | | 1005 | MG128-23 Deaminase | Protein | Unknown | Uncultivated Organism |
| MG128 Deaminase | | 1006 | MG128-24 Deaminase | Protein | Unknown | Uncultivated Organism |
| MG128 Deaminase | | 1007 | MG128-25 Deaminase | Protein | Unknown | Uncultivated Organism |
| MG128 Deaminase | | 1008 | MG128-26 Deaminase | Protein | Unknown | Uncultivated Organism |
| MG128 Deaminase | | 1009 | MG128-27 Deaminase | Protein | Unknown | Uncultivated Organism |
| MG128 Deaminase | | 1010 | MG128-28 Deaminase | Protein | Unknown | Uncultivated Organism |
| MG128 Deaminase | | 1011 | MG128-29 Deaminase | Protein | Unknown | Uncultivated Organism |
| MG128 Deaminase | | 1012 | MG128-30 Deaminase | Protein | Unknown | Uncultivated Organism |
| MG128 Deaminase | | 1013 | MG128-31 Deaminase | Protein | Unknown | Uncultivated Organism |
| MG128 Deaminase | | 1014 | MG128-32 Deaminase | Protein | Unknown | Uncultivated Organism |
| MG129 Deaminase | | 1015 | MG129-1 Deaminase | Protein | Unknown | Uncultivated Organism |
| MG129 Deaminase | | 1016 | MG129-2 Deaminase | Protein | Unknown | Uncultivated Organism |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG129 Deaminase | | 1017 | MG129-3 Deaminase | Protein | Unknown | Uncultivated Organism |
| MG129 Deaminase | | 1018 | MG129-4 Deaminase | Protein | Unknown | Uncultivated Organism |
| MG129 Deaminase | | 1019 | MG129-5 Deaminase | Protein | Unknown | Uncultivated Organism |
| MG129 Deaminase | | 1020 | MG129-6 Deaminase | Protein | Unknown | Uncultivated Organism |
| MG129 Deaminase | | 1021 | MG129-7 Deaminase | Protein | Unknown | Uncultivated Organism |
| MG129 Deaminase | | 1022 | MG129-8 Deaminase | Protein | Unknown | Uncultivated Organism |
| MG129 Deaminase | | 1023 | MG129-9 Deaminase | Protein | Unknown | Uncultivated Organism |
| MG129 Deaminase | | 1024 | MG129-10 Deaminase | Protein | Unknown | Uncultivated Organism |
| MG129 Deaminase | | 1025 | MG129-11 Deaminase | Protein | Unknown | Uncultivated Organism |
| MG129 Deaminase | | 1026 | MG129-12 Deaminase | Protein | Unknown | Uncultivated Organism |
| MG130 Deaminase | | 1027 | MG130-1 Deaminase | Protein | Unknown | Uncultivated Organism |
| MG130 Deaminase | | 1028 | MG130-2 Deaminase | Protein | Unknown | Uncultivated Organism |
| MG130 Deaminase | | 1029 | MG130-3 Deaminase | Protein | Unknown | Uncultivated Organism |
| MG130 Deaminase | | 1030 | MG130-4 Deaminase | Protein | Unknown | Uncultivated Organism |
| MG130 Deaminase | | 1031 | MG130-5 Deaminase | Protein | Unknown | Uncultivated Organism |
| MG131 Deaminase | | 1032 | MG131-1 Deaminase | Protein | Unknown | Uncultivated Organism |
| MG131 Deaminase | | 1033 | MG131-2 Deaminase | Protein | Unknown | Uncultivated Organism |
| MG131 Deaminase | | 1034 | MG131-3 Deaminase | Protein | Unknown | Uncultivated Organism |
| MG131 Deaminase | | 1035 | MG131-4 Deaminase | Protein | Unknown | Uncultivated Organism |
| MG131 Deaminase | | 1036 | MG131-5 Deaminase | Protein | Unknown | Uncultivated Organism |
| MG131 Deaminase | | 1037 | MG131-6 Deaminase | Protein | Unknown | Uncultivated Organism |
| MG131 Deaminase | | 1038 | MG131-7 Deaminase | Protein | Unknown | Uncultivated Organism |
| MG131 Deaminase | | 1039 | MG131-8 Deaminase | Protein | Unknown | Uncultivated Organism |
| MG131 Deaminase | | 1040 | MG131-9 Deaminase | Protein | Unknown | Uncultivated Organism |
| MG132 Deaminase | | 1041 | MG132-1 Deaminase | Protein | Unknown | Uncultivated Organism |
| MG132 Deaminase | | 1042 | MG132-2 Deaminase | Protein | Unknown | Uncultivated Organism |
| MG132 Deaminase | | 1043 | MG132-3 Deaminase | Protein | Unknown | Uncultivated Organism |
| MG133 Deaminase | | 1044 | MG133-1 Deaminase | Protein | Unknown | Uncultivated Organism |
| MG133 Deaminase | | 1045 | MG133-2 Deaminase | Protein | Unknown | Uncultivated Organism |
| MG133 Deaminase | | 1046 | MG133-3 Deaminase | Protein | Unknown | Uncultivated Organism |
| MG133 Deaminase | | 1047 | MG133-4 Deaminase | Protein | Unknown | Uncultivated Organism |
| MG133 Deaminase | | 1048 | MG133-5 Deaminase | Protein | Unknown | Uncultivated Organism |
| MG133 Deaminase | | 1049 | MG133-6 Deaminase | Protein | Unknown | Uncultivated Organism |
| MG133 Deaminase | | 1050 | MG133-7 Deaminase | Protein | Unknown | Uncultivated Organism |
| MG133 Deaminase | | 1051 | MG133-8 Deaminase | Protein | Unknown | Uncultivated Organism |
| MG133 Deaminase | | 1052 | MG133-9 Deaminase | Protein | Unknown | Uncultivated Organism |
| MG133 Deaminase | | 1053 | MG133-10 Deaminase | Protein | Unknown | Uncultivated Organism |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG133 Deaminase | | 1054 | MG133-11 Deaminase | Protein | Unknown | Uncultivated Organism |
| MG133 Deaminase | | 1055 | MG133-12 Deaminase | Protein | Unknown | Uncultivated Organism |
| MG133 Deaminase | | 1056 | MG133-13 Deaminase | Protein | Unknown | Uncultivated Organism |
| MG133 Deaminase | | 1057 | MG133-14 Deaminase | Protein | Unknown | Uncultivated Organism |
| MG134 Deaminase | | 1058 | MG134-1 Deaminase | Protein | Unknown | Uncultivated Organism |
| MG134 Deaminase | | 1059 | MG134-2 Deaminase | Protein | Unknown | Uncultivated Organism |
| MG134 Deaminase | | 1060 | MG134-3 Deaminase | Protein | Unknown | Uncultivated Organism |
| MG134 Deaminase | | 1061 | MG134-4 Deaminase | Protein | Unknown | Uncultivated Organism |
| MG135 Deaminase | | 1062 | MG135-1 Deaminase | Protein | Unknown | Uncultivated Organism |
| MG135 Deaminase | | 1063 | MG135-2 Deaminase | Protein | Unknown | Uncultivated Organism |
| MG135 Deaminase | | 1064 | MG135-3 Deaminase | Protein | Unknown | Uncultivated Organism |
| MG135 Deaminase | | 1065 | MG135-4 Deaminase | Protein | Unknown | Uncultivated Organism |
| MG135 Deaminase | | 1066 | MG135-5 Deaminase | Protein | Unknown | Uncultivated Organism |
| MG135 Deaminase | | 1067 | MG135-6 Deaminase | Protein | Unknown | Uncultivated Organism |
| MG135 Deaminase | | 1068 | MG135-7 Deaminase | Protein | Unknown | Uncultivated Organism |
| MG135 Deaminase | | 1069 | MG135-8 Deaminase | Protein | Unknown | Uncultivated Organism |
| MG136 Deaminase | | 1070 | MG136-1 Deaminase | Protein | Unknown | Uncultivated Organism |
| MG136 Deaminase | | 1071 | MG136-2 Deaminase | Protein | Unknown | Uncultivated Organism |
| MG136 Deaminase | | 1072 | MG136-3 Deaminase | Protein | Unknown | Uncultivated Organism |
| MG136 Deaminase | | 1073 | MG136-4 Deaminase | Protein | Unknown | Uncultivated Organism |
| MG136 Deaminase | | 1074 | MG136-5 Deaminase | Protein | Unknown | Uncultivated Organism |
| MG136 Deaminase | | 1075 | MG136-6 Deaminase | Protein | Unknown | Uncultivated Organism |
| MG136 Deaminase | | 1076 | MG136-7 Deaminase | Protein | Unknown | Uncultivated Organism |
| MG136 Deaminase | | 1077 | MG136-8 Deaminase | Protein | Unknown | Uncultivated Organism |
| MG136 Deaminase | | 1078 | MG136-9 Deaminase | Protein | Unknown | Uncultivated Organism |
| MG136 Deaminase | | 1079 | MG136-10 Deaminase | Protein | Unknown | Uncultivated Organism |
| MG136 Deaminase | | 1080 | MG136-11 Deaminase | Protein | Unknown | Uncultivated Organism |
| MG136 Deaminase | | 1081 | MG136-12 Deaminase | Protein | Unknown | Uncultivated Organism |
| MG137 Deaminase | | 1082 | MG137-1 Deaminase | Protein | Unknown | Uncultivated Organism |
| MG137 Deaminase | | 1083 | MG137-2 Deaminase | Protein | Unknown | Uncultivated Organism |
| MG137 Deaminase | | 1084 | MG137-3 Deaminase | Protein | Unknown | Uncultivated Organism |
| MG137 Deaminase | | 1085 | MG137-4 Deaminase | Protein | Unknown | Uncultivated Organism |
| MG137 Deaminase | | 1086 | MG137-5 Deaminase | Protein | Unknown | Uncultivated Organism |
| MG137 Deaminase | | 1087 | MG137-6 Deaminase | Protein | Unknown | Uncultivated Organism |
| MG137 Deaminase | | 1088 | MG137-7 Deaminase | Protein | Unknown | Uncultivated Organism |
| MG137 Deaminase | | 1089 | MG137-8 Deaminase | Protein | Unknown | Uncultivated Organism |
| MG137 Deaminase | | 1090 | MG137-9 Deaminase | Protein | Unknown | Uncultivated Organism |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG137 Deaminase | | 1091 | MG137-10 Deaminase | Protein | Unknown | Uncultivated Organism |
| MG137 Deaminase | | 1092 | MG137-11 Deaminase | Protein | Unknown | Uncultivated Organism |
| MG137 Deaminase | | 1093 | MG137-12 Deaminase | Protein | Unknown | Uncultivated Organism |
| MG137 Deaminase | | 1094 | MG137-13 Deaminase | Protein | Unknown | Uncultivated Organism |
| MG137 Deaminase | | 1095 | MG137-14 Deaminase | Protein | Unknown | Uncultivated Organism |
| MG137 Deaminase | | 1096 | MG137-15 Deaminase | Protein | Unknown | Uncultivated Organism |
| MG137 Deaminase | | 1097 | MG137-16 Deaminase | Protein | Unknown | Uncultivated Organism |
| MG137 Deaminase | | 1098 | MG137-17 Deaminase | Protein | Unknown | Uncultivated Organism |
| MG35 active effectors sgRNA | | 1099 | MG35-1 active effectors sgRNA | nucleotide | artificial sequence | N/A |
| MG35 active effectors sgRNA | | 1100 | MG35-2 active effectors sgRNA | nucleotide | artificial sequence | N/A |
| MG35 active effectors sgRNA | | 1101 | MG35-3 active effectors sgRNA | nucleotide | artificial sequence | N/A |
| MG35 active effectors sgRNA | | 1102 | MG35-4 active effectors sgRNA | nucleotide | artificial sequence | N/A |
| MG35 active effectors sgRNA | | 1103 | MG35-5 active effectors sgRNA | nucleotide | artificial sequence | N/A |
| MG35 active effectors sgRNA | | 1104 | MG35-6 active effectors sgRNA | nucleotide | artificial sequence | N/A |
| MG35 active effectors sgRNA | | 1105 | MG35-102 active effectors sgRNA | nucleotide | artificial sequence | N/A |
| MG35 active effectors PAM | | | MG35-1 active effectors PAM | nucleotide | artificial sequence | AnGg |
| MG35 active effectors PAM | A1107 | | MG35-2 active effectors PAM | nucleotide | artificial sequence | nARAA |
| MG35 active effectors PAM | A1108 | | MG35-3 active effectors PAM | nucleotide | artificial sequence | ATGaaa |
| MG35 active effectors PAM | A1109 | | MG35-4 active effectors PAM | nucleotide | artificial sequence | ATGA |
| MG35 active effectors PAM | A1110 | | MG35-5 active effectors PAM | nucleotide | artificial sequence | WTGG |
| MG35 active effectors PAM | A1111 | | MG35-102 active effectors PAM | nucleotide | artificial sequence | RTGA |
| ABE-MG35 active adenine base | | 1112 | ABE-MG35-1 active adenine base editor gene | nucleotide | artificial sequence | N/A |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| editor genes | | | | | | |
| ABE-MG35 active adenine base editors | | 1113 | ABE-MG35-1 active adenine base editor | protein | artificial sequence | N/A |
| Cas9-CBE | | 1114 | pMG3078 | Nucleotide | | |
| Fam72a | | 1115 | pMG3072 | Nucleotide | | |
| Cas9-CBE target site | | 1116 | PE266 | Nucleotide | | |
| Cas9-CBE target site | | 1117 | PE691 | Nucleotide | | |
| NGS Amplicon | | 1118 | PE266 NGS Amplicon | Nucleotide | | |
| NGS Amplicon | | 1119 | PE691 NGS Amplicon | Nucleotide | | |
| MG35 active effector | | 1120 | MG35-1 active effector amino acid sequence | Polypeptide | | |
| FAM72 A | | 1121 | Fam72A peptide sequence | Polypeptide | | |
| MG35 active effector | | 1122 | MG35-2 active effector amino acid sequence | Polypeptide | | |
| MG35 active effector | | 1123 | MG35-3 active effector amino acid sequence | Polypeptide | | |
| MG35 active effector | | 1124 | MG35-4 active effector amino acid sequence | Polypeptide | | |
| MG35 active effector | | 1125 | MG35-5 active effector amino acid sequence | Polypeptide | | |
| MG35 active effector | | 1126 | MG35-6 active effector amino acid sequence | Polypeptide | | |
| MG35 active effector | | 1127 | MG35-102 active effector amino acid sequence | Polypeptide | | |
| MG3-6_3-8 adenine base editor | | 1128 | 3-68_DIV1_M_RDr1v1_B | Protein | artificial sequence | |
| MG3-6_3-8 adenine base editor | | 1129 | 3-68_DIV2_M_RDr1v1_B | Protein | artificial sequence | |
| MG3-6_3-8 adenine base editor | | 1130 | 3-68_DIV3_M_RDr1v1_B | Protein | artificial sequence | |
| MG3-6_3-8 adenine base editor | | 1131 | 3-68_DIV4_M_RDr1v1_B | Protein | artificial sequence | |
| MG3-6_3-8 adenine base editor | | 1132 | 3-68_DIV5_M_RDr1v1_B | Protein | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG3-6_3-8 adenine base editor | | 1133 | 3-68_DIV6_M_RDr1v1_B | Protein | artificial sequence | |
| MG3-6_3-8 adenine base editor | | 1134 | 3-68_DIV7_M_RDr1v1_B | Protein | artificial sequence | |
| MG3-6_3-8 adenine base editor | | 1135 | 3-68_DIV8_M_RDr1v1_B | Protein | artificial sequence | |
| MG3-6_3-8 adenine base editor | | 1136 | 3-68_DIV9_M_RDr1v1_B | Protein | artificial sequence | |
| MG3-6_3-8 adenine base editor | | 1137 | 3-68_DIV10_M_RDr1v1_B | Protein | artificial sequence | |
| MG3-6_3-8 adenine base editor | | 1138 | 3-68_DIV11_M_RDr1v1_B | Protein | artificial sequence | |
| MG3-6_3-8 adenine base editor | | 1139 | 3-68_DIV12_M_RDr1v1_B | Protein | artificial sequence | |
| MG3-6_3-8 adenine base editor | | 1140 | 3-68_DIV13_M_RDr1v1_B | Protein | artificial sequence | |
| MG3-6_3-8 adenine base editor | | 1141 | 3-68_DIV14_M_RDr1v1_B | Protein | artificial sequence | |
| MG3-6_3-8 adenine base editor | | 1142 | 3-68_DIV15_M_RDr1v1_B | Protein | artificial sequence | |
| MG3-6_3-8 adenine base editor | | 1143 | 3-68_DIV16_M_RDr1v1_B | Protein | artificial sequence | |
| MG3-6_3-8 adenine base editor | | 1144 | 3-68_DIV17_M_RDr1v1_B | Protein | artificial sequence | |
| MG3-6_3-8 adenine base editor | | 1145 | 3-68_DIV18_M_RDr1v1_B | Protein | artificial sequence | |
| MG3-6_3-8 adenine base editor | | 1146 | 3-68_DIV19_M_RDr1v1_B | Protein | artificial sequence | |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG3-6_3-8 adenine base editor | | 1147 | 3-68_DIV20_M_RDr1v1_B | Protein | artificial sequence | |
| MG3-6_3-8 adenine base editor | | 1148 | 3-68_DIV21_M_RDr1v1_B | Protein | artificial sequence | |
| MG3-6_3-8 adenine base editor | | 1149 | 3-68_DIV22_M_RDr1v1_B | Protein | artificial sequence | |
| MG3-6_3-8 adenine base editor | | 1150 | 3-68_DIV23_M_RDr1v1_B | Protein | artificial sequence | |
| MG3-6_3-8 adenine base editor | | 1151 | 3-68_DIV24_M_RDr1v1_B | Protein | artificial sequence | |
| MG3-6_3-8 adenine base editor | | 1152 | 3-68_DIV25_M_RDr1v1_B | Protein | artificial sequence | |
| MG3-6_3-8 adenine base editor | | 1153 | 3-68_DIV26_M_RDr1v1_B | Protein | artificial sequence | |
| MG3-6_3-8 adenine base editor | | 1154 | 3-68_DIV27_M_RDr1v1_B | Protein | artificial sequence | |
| MG3-6_3-8 adenine base editor | | 1155 | 3-68_DIV28_M_RDr1v1_B | Protein | artificial sequence | |
| MG3-6_3-8 adenine base editor | | 1156 | 3-68_DIV29_M_RDr1v1_B | Protein | artificial sequence | |
| MG3-6_3-8 adenine base editor | | 1157 | 3-68_DIV30_M_RDr1v1_B | Protein | artificial sequence | |
| MG3-6_3-8 adenine base editor | | 1158 | 3-68_DIV31_M_RDr1v1_B | Protein | artificial sequence | |
| MG3-6_3-8 adenine base editor | | 1159 | 3-68_DIV32_M_RDr1v1_B | Protein | artificial sequence | |
| MG3-6_3-8 adenine base editor | | 1160 | 3-68_DIV33_M_RDr1v1_B | Protein | artificial sequence | |
| MG34-1 adenine base editor | | 1161 | MG68-4 | Protein | artificial sequence | MG34-1 sequence is included |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG34-1 adenine base editor | | 1162 | MGA1.1RD1 | Protein | artificial sequence | MG34-1 sequence is included |
| MG34-1 adenine base editor | | 1163 | MGA1.1RD2 | Protein | artificial sequence | MG34-1 sequence is included |
| MG34-1 adenine base editor | | 1164 | MGA1.1RD3 | Protein | artificial sequence | MG34-1 sequence is included |
| MG34-1 adenine base editor | | 1165 | MGA1.1RD4 | Protein | artificial sequence | MG34-1 sequence is included |
| MG34-1 adenine base editor | | 1166 | MGA1.1RD5 | Protein | artificial sequence | MG34-1 sequence is included |
| MG34-1 adenine base editor | | 1167 | MGA1.1RD6 | Protein | artificial sequence | MG34-1 sequence is included |
| MG34-1 adenine base editor | | 1168 | MGA1.1RD7 | Protein | artificial sequence | MG34-1 sequence is included |
| MG34-1 adenine base editor | | 1169 | MGA1.1RD8 | Protein | artificial sequence | MG34-1 sequence is included |
| MG34-1 adenine base editor | | 1170 | MGA1.1RD9 | Protein | artificial sequence | MG34-1 sequence is included |
| MG34-1 adenine base editor | | 1171 | MGA1.1RD10 | Protein | artificial sequence | MG34-1 sequence is included |
| MG34-1 adenine base editor | | 1172 | MGA1.1RD11 | Protein | artificial sequence | MG34-1 sequence is included |
| MG34-1 adenine base editor | | 1173 | MGA1.1RD12 | Protein | artificial sequence | MG34-1 sequence is included |
| MG34-1 adenine base editor | | 1174 | MGA1.1RD13 | Protein | artificial sequence | MG34-1 sequence is included |
| MG34-1 adenine base editor | | 1175 | MGA1.1RD14 | Protein | artificial sequence | MG34-1 sequence is included |
| MG34-1 adenine base editor | | 1176 | MGA1.1RD15 | Protein | artificial sequence | MG34-1 sequence is included |
| MG34-1 adenine base editor | | 1177 | MGA1.1RD16 | Protein | artificial sequence | MG34-1 sequence is included |
| MG34-1 adenine base editor | | 1178 | MGA1.1RD17 | Protein | artificial sequence | MG34-1 sequence is included |
| MG34-1 adenine base editor | | 1179 | MGA1.1RD18 | Protein | artificial sequence | MG34-1 sequence is included |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG34-1 adenine base editor | | 1180 | MGA1.1RD19 | Protein | artificial sequence | MG34-1 sequence is included |
| MG34-1 adenine base editor | | 1181 | MGA1.1RD20 | Protein | artificial sequence | MG34-1 sequence is included |
| MG34-1 adenine base editor | | 1182 | MGA1.1RD21 | Protein | artificial sequence | MG34-1 sequence is included |
| MG34-1 adenine base editor | | 1183 | MGA1.1RD22 | Protein | artificial sequence | MG34-1 sequence is included |
| MG34-1 adenine base editor | | 1184 | MAG0.1_2NLS | Protein | artificial sequence | MG34-1 sequence is included |
| MG34-1 adenine base editor | | 1185 | MAG1.1 2NLS | Protein | artificial sequence | MG34-1 sequence is included |
| MG34-1 adenine base editor | | 1186 | MAG2.1 2NLS | Protein | artificial sequence | MG34-1 sequence is included |
| MG34-1 adenine base editor sgRNA6 8 sequence | | 1187 | guide 2 for ABE using MG34-1 | Nucleotide | artificial sequence | |
| MG3-6_3-8 adenine base editor sgRNA sequence | | 1188 | sgRNA68 | Nucleotide | artificial sequence | |
| MG3-6_3-8 adenine base editor sgRNA sequence | | 1189 | sgRNA46 | Nucleotide | artificial sequence | |
| MG3-6_3-8 adenine base editor sgRNA sequence | | 1190 | sgRNA49 | Nucleotide | artificial sequence | |
| MG3-6_3-8 adenine base editor sgRNA sequence | | 1191 | sgRNA51 | Nucleotide | artificial sequence | |
| MG3-6_3-8 adenine base editor sgRNA sequence | | 1192 | sgRNA53 | Nucleotide | artificial sequence | |
| MG3-6_3-8 adenine base | | 1193 | sgRNA54 | Nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| editor sgRNA sequence | | | | | | |
| MG3-6_3-8 adenine base editor sgRNA sequence | | 1194 | sgRNA55 | Nucleotide | artificial sequence | |
| MG3-6_3-8 adenine base editor sgRNA sequence | | 1195 | sgRNA62 | Nucleotide | artificial sequence | |
| DNA Sequence of Target Site | | 1196 | guide 2 for ABE using MG34-1 | Nucleotide | artificial sequence | |
| DNA Sequence of Target Site | | 1197 | sgRNA68 | Nucleotide | artificial sequence | |
| DNA Sequence of Target Site | | 1198 | sgRNA46 | Nucleotide | artificial sequence | |
| DNA Sequence of Target Site | | 1199 | sgRNA49 | Nucleotide | artificial sequence | |
| DNA Sequence of Target Site | | 1200 | sgRNA51 | Nucleotide | artificial sequence | |
| DNA Sequence of Target Site | | 1201 | sgRNA53 | Nucleotide | artificial sequence | |
| DNA Sequence of Target Site | | 1202 | sgRNA54 | Nucleotide | artificial sequence | |
| DNA Sequence of Target Site | | 1203 | sgRNA55 | Nucleotide | artificial sequence | |
| DNA Sequence of Target Site | | 1204 | sgRNA62 | Nucleotide | artificial sequence | |
| Plasmid | | 1205 | Expression of MG3-6_3-8 adenine base editor | Nucleotide | artificial sequence | |
| Plasmid | | 1206 | Expression of sgRNA for MG3-6_3-8 adenine base editor | Nucleotide | artificial sequence | |
| Plasmid | | 1207 | Expression of MG34-1 adenine base editor | Nucleotide | artificial sequence | |
| MG93 cytidine deaminase variant | | 1208 | W90A | MG93_4v1 | Protein | Rodent class |
| MG93 cytidine deaminase variant | | 1209 | W90F | MG93_4v2 | Protein | Rodent class |
| MG93 cytidine deaminase variant | | 1210 | W90H | MG93_4v3 | Protein | Rodent class |
| MG93 cytidine | | 1211 | W90Y | MG93_4v4 | Protein | Rodent class |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| deaminase variant | | | | | | |
| MG93 cytidine deaminase variant | | 1212 | Y120F | MG93_4v5 | Protein | Rodent class |
| MG93 cytidine deaminase variant | | 1213 | Y120H | MG93_4v6 | Protein | Rodent class |
| MG93 cytidine deaminase variant | | 1214 | Y121F | MG93_4v7 | Protein | Rodent class |
| MG93 cytidine deaminase variant | | 1215 | Y121H | MG93_4v8 | Protein | Rodent class |
| MG93 cytidine deaminase variant | | 1216 | Y121Q | MG93_4v9 | Protein | Rodent class |
| MG93 cytidine deaminase variant | | 1217 | Y121A | MG93_4v10 | Protein | Rodent class |
| MG93 cytidine deaminase variant | | 1218 | Y121D | MG93_4v11 | Protein | Rodent class |
| MG93 cytidine deaminase variant | | 1219 | Y121W | MG93_4v12 | Protein | Rodent class |
| MG93 cytidine deaminase variant | | 1220 | H122Y | MG93_4v13 | Protein | Rodent class |
| MG93 cytidine deaminase variant | | 1221 | H122F | MG93_4v14 | Protein | Rodent class |
| MG93 cytidine deaminase variant | | 1222 | H122I | MG93_4v15 | Protein | Rodent class |
| MG93 cytidine deaminase variant | | 1223 | H122A | MG93_4v16 | Protein | Rodent class |
| MG93 cytidine deaminase variant | | 1224 | H122W | MG93_4v17 | Protein | Rodent class |
| MG93 cytidine deaminase variant | | 1225 | H122D | MG93_4v18 | Protein | Rodent class |
| MG93 cytidine deaminase variant | | 1226 | Replace with hAID loop7 | MG93_4v19 | Protein | Rodent class |
| MG93 cytidine deaminase variant | | 1227 | Replace with 139_86 loop 7 | MG93_4v20 | Protein | Rodent class |
| MG93 cytidine deaminase variant | | 1228 | Truncate from 188 to end | MG93_4v21 | Protein | Rodent class |
| MG93 cytidine deaminase variant | | 1229 | Y121T | MG93_4v22 | Protein | Rodent class |

TABLE 2-continued

| Category | Sequence Number | SEQ ID NO: | Description | Type | Organism | Other Information or Sequence |
|---|---|---|---|---|---|---|
| Sequence Listing of Protein and Nucleic Acid Sequences Referred to Herein | | | | | | |
| MG93 cytidine deaminase variant | | 1230 | Replace with a smaller section of hAID loop7 | MG93_4v23 | Protein | Rodent class |
| MG93 cytidine deaminase variant | | 1231 | Replace with a smaller section of hAID loop7 | MG93_4v24 | Protein | Rodent class |
| MG93 cytidine deaminase variant | | 1232 | R33A | MG93_4v25 | Protein | Rodent class |
| MG93 cytidine deaminase variant | | 1233 | R34A | MG93_4v26 | Protein | Rodent class |
| MG93 cytidine deaminase variant | | 1234 | R34K | MG93_4v27 | Protein | Rodent class |
| MG93 cytidine deaminase variant | | 1235 | H122A R33A | MG93_4v28 | Protein | Rodent class |
| MG93 cytidine deaminase variant | | 1236 | H122A R34A | MG93_4v29 | Protein | Rodent class |
| MG93 cytidine deaminase variant | | 1237 | R52A | MG93_4v30 | Protein | Rodent class |
| MG93 cytidine deaminase variant | | 1238 | H122A R52A | MG93_4v31 | Protein | Rodent class |
| MG93 cytidine deaminase variant | | 1239 | N57G (Shown to have lower off target activity in A3A) | MG93_4v32 | Protein | Rodent class |
| MG93 cytidine deaminase variant | | 1240 | N57G H122A | MG93_4v33 | Protein | Rodent class |
| MG93 cytidine deaminase variant | | 1241 | Replace with A3A loop7 | MG139_86v1 | Protein | Rodent class |
| MG93 cytidine deaminase variant | | 1242 | E123A | MG139_95v1 | Protein | Rodent class |
| MG93 cytidine deaminase variant | | 1243 | E123Q | MG139_95v2 | Protein | Rodent class |
| MG93 cytidine deaminase variant | | 1244 | Replace with hAID loop7 | MG93_3v1 | Protein | Rodent class |
| MG93 cytidine deaminase variant | | 1245 | Replace with 139_86 loop 7 | MG93_3v2 | Protein | Rodent class |
| MG93 cytidine deaminase variant | | 1246 | W127F | MG93_3v3 | Protein | Rodent class |
| MG93 cytidine deaminase variant | | 1247 | W127H | MG93_3v4 | Protein | Rodent class |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG93 cytidine deaminase variant | | 1248 | W127Q | MG93_3v5 | Protein | Rodent class |
| MG93 cytidine deaminase variant | | 1249 | W127A | MG93_3v6 | Protein | Rodent class |
| MG93 cytidine deaminase variant | | 1250 | W127D | MG93_3v7 | Protein | Rodent class |
| MG93 cytidine deaminase variant | | 1251 | R39A | MG93_3v8 | Protein | Rodent class |
| MG93 cytidine deaminase variant | | 1252 | K40A | MG93_3v9 | Protein | Rodent class |
| MG93 cytidine deaminase variant | | 1253 | H128A | MG93_3v10 | Protein | Rodent class |
| MG93 cytidine deaminase variant | | 1254 | N63G | MG93_3v11 | Protein | Rodent class |
| MG93 cytidine deaminase variant | | 1255 | R58A | MG93_3v12 | Protein | Rodent class |
| MG93 cytidine deaminase variant | | 1256 | Replace with hAID loop7 | MG93_11v1 | Protein | Rodent class |
| MG93 cytidine deaminase variant | | 1257 | Replace with 139_86 loop 7 | MG93_11v2 | Protein | Rodent class |
| MG93 cytidine deaminase variant | | 1258 | H121F | MG93_11v3 | Protein | Rodent class |
| MG93 cytidine deaminase variant | | 1259 | H121Y | MG93_11v4 | Protein | Rodent class |
| MG93 cytidine deaminase variant | | 1260 | H121Q | MG93_11v5 | Protein | Rodent class |
| MG93 cytidine deaminase variant | | 1261 | H121A | MG93_11v6 | Protein | Rodent class |
| MG93 cytidine deaminase variant | | 1262 | H121D | MG93_11v7 | Protein | Rodent class |
| MG93 cytidine deaminase variant | | 1263 | H121W | MG93_11v8 | Protein | Rodent class |
| MG93 cytidine deaminase variant | | 1264 | N57G (Shown to have lower off target activity in A3A) | MG93_11v9 | Protein | Rodent class |
| MG93 cytidine deaminase variant | | 1265 | R33A | MG93_11v10 | Protein | Rodent class |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG93 cytidine deaminase variant | | 1266 | K34A | MG93_11v11 | Protein | Rodent class |
| MG93 cytidine deaminase variant | | 1267 | H122A | MG93_11v12 | Protein | Rodent class |
| MG93 cytidine deaminase variant | | 1268 | H121A | MG93_11v13 | Protein | Rodent class |
| MG93 cytidine deaminase variant | | 1269 | R52A | MG93_11v14 | Protein | Rodent class |
| MG139 cytidine deaminase variant | | 1270 | K16 through P25 of pgtA3H replaces G20 through P26 | 139_52v1 | Protein | uncultivated organism |
| MG139 cytidine deaminase variant | | 1271 | S170 through D138 of pgtA3H replaces K196 to V215 | 139_52v2 | Protein | uncultivated organism |
| MG139 cytidine deaminase variant | | 1272 | P26R | 139_52v3 | Protein | uncultivated organism |
| MG139 cytidine deaminase variant | | 1273 | P26A | 139_52v4 | Protein | uncultivated organism |
| MG139 cytidine deaminase variant | | 1274 | N27R | 139_52v5 | Protein | uncultivated organism |
| MG139 cytidine deaminase variant | | 1275 | N27A | 139_52v6 | Protein | uncultivated organism |
| MG139 cytidine deaminase variant | | 1276 | W44A (equivalent to R52A) | 139_52v7 | Protein | uncultivated organism |
| MG139 cytidine deaminase variant | | 1277 | W45A (equivalent to R52A) | 139_52v8 | Protein | uncultivated organism |
| MG139 cytidine deaminase variant | | 1278 | K49G (equivalent to N57G) | 139_52v9 | Protein | uncultivated organism |
| MG139 cytidine deaminase variant | | 1279 | S50G (equivalent to N57G) | 139_52v10 | Protein | uncultivated organism |
| MG139 cytidine deaminase variant | | 1280 | R51G (equivalent to N57G) | 139_52v11 | Protein | uncultivated organism |
| MG139 cytidine deaminase variant | | 1281 | R121A (equivalent to H121A) | 139_52v12 | Protein | uncultivated organism |
| MG139 cytidine deaminase variant | | 1282 | I122A (equivalent to H122A) | 139_52v13 | Protein | uncultivated organism |
| MG139 cytidine deaminase variant | | 1283 | N123A (equivalent to H122A) | 139_52v14 | Protein | uncultivated organism |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG139 cytidine deaminase variant | | 1284 | Y88F (equivalent to W90F) | 139_52v15 | Protein | uncultivated organism |
| MG139 cytidine deaminase variant | | 1285 | Y120F (equivalent to Y120F) | 139_52v16 | Protein | uncultivated organism |
| MG139 cytidine deaminase variant | | 1286 | P22R | 139_86v2 | Protein | uncultivated organism |
| MG139 cytidine deaminase variant | | 1287 | P22A | 139_86v3 | Protein | uncultivated organism |
| MG139 cytidine deaminase variant | | 1288 | K23A | 139_86v4 | Protein | uncultivated organism |
| MG139 cytidine deaminase variant | | 1289 | K41R | 139_86v5 | Protein | uncultivated organism |
| MG139 cytidine deaminase variant | | 1290 | K41A | 139_86v6 | Protein | uncultivated organism |
| MG139 cytidine deaminase variant | | 1291 | truncate K179 and onwards | 139_86v7 | Protein | uncultivated organism |
| MG139 cytidine deaminase variant | | 1292 | Insert hAID loop 7 and truncate K179 onwards | 139_86v8 | Protein | uncultivated organism |
| MG139 cytidine deaminase variant | | 1293 | E54D and truncation | 139_86v9 | Protein | uncultivated organism |
| MG139 cytidine deaminase variant | | 1294 | E54A Mutate catalytic E residue | 139_86v10 | Protein | uncultivated organism |
| MG139 cytidine deaminase variant | | 1295 | Mutate neighboring E residue | 139_86v11 | Protein | uncultivated organism |
| MG139 cytidine deaminase variant | | 1296 | E54AE55A Mutate both catalytic E residues | 139_86v12 | Protein | uncultivated organism |
| MG152 cytidine deaminase variant | | 1297 | K30A | 152_6v1 | Protein | Bivalvia class |
| MG152 cytidine deaminase variant | | 1298 | K30R | 152_6v2 | Protein | Bivalvia class |
| MG152 cytidine deaminase variant | | 1299 | M32A | 152_6v3 | Protein | Bivalvia class |
| MG152 cytidine deaminase variant | | 1300 | M32K | 152_6v4 | Protein | Bivalvia class |
| MG152 cytidine deaminase variant | | 1301 | Y117A | 152_6v5 | Protein | Bivalvia class |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG152 cytidine deaminase variant | | 1302 | K118A | 152_6v6 | Protein | Bivalvia class |
| MG152 cytidine deaminase variant | | 1303 | I119A | 152_6v7 | Protein | Bivalvia class |
| MG152 cytidine deaminase variant | | 1304 | I119H | 152_6v8 | Protein | Bivalvia class |
| MG152 cytidine deaminase variant | | 1305 | R120A | 152_6v9 | Protein | Bivalvia class |
| MG152 cytidine deaminase variant | | 1306 | R121A | 152_6v10 | Protein | Bivalvia class |
| MG152 cytidine deaminase variant | | 1307 | P46A | 152_6v11 | Protein | Bivalvia class |
| MG152 cytidine deaminase variant | | 1308 | P46R | 152_6v12 | Protein | Bivalvia class |
| MG152 cytidine deaminase variant | | 1309 | N29A | 152_6v13 | Protein | Bivalvia class |
| MG152 cytidine deaminase variant | | 1310 | Loop 7 from MG138-20 | 152_6v14 | Protein | Bivalvia class |
| MG152 cytidine deaminase variant | | 1311 | Loop 7 from MG139-12 | 152_6v15 | Protein | Bivalvia class |
| MG138 cytidine deaminase variant | | 1312 | R27A | 138_20v1 | Protein | Aves Class |
| MG138 cytidine deaminase variant | | 1313 | N50G | 138_20v2 | Protein | Aves Class |
| MG139 cytidine deaminase variant | | 1314 | Loop 7 from MG138-20 | 139_52v17 | Protein | uncultivated organism |
| MG139 cytidine deaminase variant | | 1315 | Loop 7 from MG139-12 | 139_52v18 | Protein | uncultivated organism |
| RF148 | | 1316 | | SSDNA substrate | DNA | artificial |
| RF149 | | 1317 | | SSDNA substrate | DNA | artificial |
| RF150 | | 1318 | | SSDNA substrate | DNA | artificial |
| RF151 | | 1319 | | SSDNA substrate | DNA | artificial |
| RF253 | | 1320 | AC vs GC Substrate | Dual DNA substrate | DNA | artificial |
| RF220 | | 1321 | TC v CC substrate | Dual DNA substrate | DNA | artificial |
| 152-6_CBE | | 1322 | | CDA fused linker, MG3-6, | Protein | artificial |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| | | | | UGI and NLS | | |
| 139-52v6_CBE | | 1323 | N27A | CDA fused linker, MG3-6, UGI and NLS | Protein | artificial |
| 93-4_CBE | | 1324 | | CDA fused linker, MG3-6, UGI and NLS | Protein | artificial |
| 139-52_CBE | | 1325 | | CDA fused linker, MG3-6, UGI and NLS | Protein | artificial |
| 139-94_CBE | | 1326 | | CDA fused linker MG3-6, UGI and NLS | Protein | artificial |
| 93-7_CBE | | 1327 | | CDA fused linker, MG3-6, UGI and NLS | Protein | artificial |
| 93-3_CBE | | 1328 | | CDA fused linker, MG3-6, UGI and NLS | Protein | artificial |
| 139-92_CBE | | 1329 | | CDA fused linker, MG3-6, UGI and NLS | Protein | artificial |
| 139-12_CBE | | 1330 | | CDA fused linker, MG3-6, UGI and NLS | Protein | artificial |
| 139-103_CBE | | 1331 | | CDA fused linker, MG3-6, UGI and NLS | Protein | artificial |
| 139-95_CBE | | 1332 | | CDA fused linker, MG3-6, UGI and NLS | Protein | artificial |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| 139-99_CBE | | 1333 | | CDA fused linker, MG3-6, UGI and NLS | Protein | artificial |
| 139-90_CBE | | 1334 | | CDA fused linker, MG3-6, UGI and NLS | Protein | artificial |
| 139-89_CBE | | 1335 | | CDA fused linker, MG3-6, UGI and NLS | Protein | artificial |
| 139-93_CBE | | 1336 | | CDA fused linker, MG3-6, UGI and NLS | Protein | artificial |
| 138-30_CBE | | 1337 | | CDA fused linker, MG3-6, UGI and NLS | Protein | artificial |
| 139-102_CBE | | 1338 | | CDA fused linker, MG3-6, UGI and NLS | Protein | artificial |
| 93-4v16_CBE | | 1339 | H122A | CDA fused linker, MG3-6, UGI and NLS | Protein | artificial |
| 152-5_CBE | | 1340 | | CDA fused linker, MG3-6, UGI and NLS | Protein | artificial |
| 138-20_CBE | | 1341 | | CDA fused linker, MG3-6, UGI and NLS | Protein | artificial |
| 138-23_CBE | | 1342 | | CDA fused linker, MG3-6, UGI and NLS | Protein | artificial |
| 93-5_CBE | | 1343 | | CDA fused linker, MG3-6, | Protein | artificial |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| | | | | UGI and NLS | | |
| 152-4_CBE | | 1344 | | CDA fused linker, MG3-6, UGI and NLS | Protein | artificial |
| 152-1_CBE | | 1345 | | CDA fused linker, MG3-6, UGI and NLS | Protein | artificial |
| 152-3_CBE | | 1346 | | CDA fused linker, MG3-6, UGI and NLS | Protein | artificial |
| 139-56_CBE | | 1347 | | CDA fused linker, MG3-6, UGI and NLS | Protein | artificial |
| 93-11_CBE | | 1348 | | CDA fused linker, MG3-6, UGI and NLS | Protein | artificial |
| 93-6_CBE | | 1349 | | CDA fused linker, MG3-6, UGI and NLS | Protein | artificial |
| 93-9_CBE | | 1350 | | CDA fused linker, MG3-6, UGI and NLS | Protein | artificial |
| 142-1_CBE | | 1351 | | CDA fused linker, MG3-6, UGI and NLS | Protein | artificial |
| 138-32_CBE | | 1352 | | CDA fused linker, MG3-6, UGI and NLS | Protein | artificial |
| 139-101_CBE | | 1353 | | CDA fused linker, MG3-6, UGI and NLS | Protein | artificial |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| 138-17_CBE | | 1354 | | CDA fused linker, MG3-6, UGI and NLS | Protein | artificial |
| 139-91_CBE | | 1355 | | CDA fused linker, MG3-6, UGI and NLS | Protein | artificial |
| MG34-1 adenine base editor | | 1356 | MG68-4_MG34-1 (D10A) | Protein | artificial sequence | |
| MG34-1 adenine base editor | | 1357 | MG68-4 (D109N)_MG34-1 (D10A) | Protein | artificial sequence | |
| MG34-1 adenine base editor | | 1358 | MG68-4 (D109N homodimer_32aa linker)_MG34-1 (D10A) | Protein | artificial sequence | |
| MG34-1 adenine base editor | | 1359 | MG68-4_(D109N homodimer_52aa linker)_MG34-1 (D10A) | Protein | artificial sequence | |
| MG34-1 adenine base editor | | 1360 | MG68-4_(D109N homodimer_64aa linker)_MG34-1 (D10A) | Protein | artificial sequence | |
| MG34-1 adenine base editor | | 1361 | MG68-4_(D109N homodimer_5aa linker)_MG34-1 (D10A) | Protein | artificial sequence | |
| MG34-1 adenine base editor | | 1362 | TadA*8.8m_MG34-1 (D10A) | Protein | artificial sequence | |
| MG3-6_3-8 adenine base editor | | 1363 | 3-68_DIV30M_CMCL1 | Protein | artificial sequence | |
| MG3-6_3-8 adenine base editor | | 1364 | 3-68_DIV30M_CMCL2 | Protein | artificial sequence | |
| MG3-6_3-8 adenine base editor | | 1365 | 3-68_DIV30M_CMCL3 | Protein | artificial sequence | |
| MG3-6_3-8 adenine base editor | | 1366 | 3-68_DIV30M_CMCL4 | Protein | artificial sequence | |
| MG3-6_3-8 adenine base editor | | 1367 | 3-68_DIV30M_CMCL5 | Protein | artificial sequence | |
| MG3-6_3-8 adenine base editor | | 1368 | 3-68_DIV30M_CMCL6 | Protein | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG3-6_3-8 adenine base editor | | 1369 | 3-68_DIV30M_CMCL7 | Protein | artificial sequence | |
| MG3-6_3-8 adenine base editor | | 1370 | 3-68_DIV30M_CMCL9 | Protein | artificial sequence | |
| MG3-6_3-8 adenine base editor | | 1371 | 3-68_DIV30M_CMCL10 | Protein | artificial sequence | |
| MG3-6_3-8 adenine base editor | | 1372 | 3-68_DIV30M_CMCL11 | Protein | artificial sequence | |
| MG3-6_3-8 adenine base editor | | 1373 | 3-68_DIV30M_CMCL12 | Protein | artificial sequence | |
| MG3-6_3-8 adenine base editor | | 1374 | 3-68_DIV30M_CMCL13 | Protein | artificial sequence | |
| MG3-6_3-8 adenine base editor | | 1375 | 3-68_DIV30M_CMCL14 | Protein | artificial sequence | |
| MG3-6_3-8 adenine base editor | | 1376 | 3-68_DIV30M_CMCL15 | Protein | artificial sequence | |
| MG3-6_3-8 adenine base editor | | 1377 | 3-68_DIV30M_CMCL16 | Protein | artificial sequence | |
| MG3-6_3-8 adenine base editor | | 1378 | 3-68_DIV30M_CMCL17 | Protein | artificial sequence | |
| MG3-6_3-8 adenine base editor | | 1379 | 3-68_DIV30M_CMCL18 | Protein | artificial sequence | |
| MG3-6_3-8 adenine base editor | | 1380 | 3-68_DIV30M_CMCL20 | Protein | artificial sequence | |
| MG3-6_3-8 adenine base editor | | 1381 | 3-68_DIV30M_CMCL22 | Protein | artificial sequence | |
| MG3-6_3-8 adenine base editor | | 1382 | 3-68_DIV30M_CMCL23 | Protein | artificial sequence | |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG3-6_3-8 adenine base editor | | 1383 | 3-68_DIV30M_CMCL25 | Protein | artificial sequence | |
| MG3-6_3-8 adenine base editor | | 1384 | 3-68_DIV30M_CMCL28 | Protein | artificial sequence | |
| MG3-6_3-8 adenine base editor | | 1385 | 3-68_DIV30M_CMCL29 | Protein | artificial sequence | |
| MG3-6_3-8 adenine base editor | | 1386 | 3-68_DIV30M_CMCL30 | Protein | artificial sequence | |
| MG3-6_3-8 adenine base editor | | 1387 | 3-68_DIV30M_CMCL34 | Protein | artificial sequence | |
| MG3-6_3-8 adenine base editor | | 1388 | 3-68_DIV30M_CMCL35 | Protein | artificial sequence | |
| MG3-6_3-8 adenine base editor | | 1389 | 3-68_DIV30M_CMCL40 | Protein | artificial sequence | |
| MG3-6_3-8 adenine base editor | | 1390 | 3-68_DIV30M_CMCL56 | Protein | artificial sequence | |
| MG3-6_3-8 adenine base editor | | 1391 | 3-68_DIV30M_CMCL57 | Protein | artificial sequence | |
| MG3-6_3-8 adenine base editor | | 1392 | 3-68_DIV30M_CMCL58 | Protein | artificial sequence | |
| MG3-6_3-8 adenine base editor | | 1393 | 3-68_DIV30M CMCL59 | Protein | artificial sequence | |
| MG3-6_3-8 adenine base editor | | 1394 | 3-68_DIV30M_CMCL60 | Protein | artificial sequence | |
| MG3-6_3-8 adenine base editor | | 1395 | 3-68_DIV30M_CMCL61 | Protein | artificial sequence | |
| MG3-6_3-8 adenine base editor | | 1396 | 3-68_DIV30M_CMCL62 | Protein | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG3-6_3-8 adenine base editor | | 1397 | 3-68_DIV30M_CMCL63 | Protein | artificial sequence | |
| MG3-6_3-8 adenine base editor | | 1398 | 3-68_DIV30M_CMCL64 | Protein | artificial sequence | |
| MG3-6_3-8 adenine base editor | | 1399 | 3-68_DIV30M_CMCL65 | Protein | artificial sequence | |
| MG3-6_3-8 adenine base editor | | 1400 | 3-68_DIV30M_CMCL66 | Protein | artificial sequence | |
| MG3-6_3-8 adenine base editor | | 1401 | 3-68_DIV30M_CMCL67 | Protein | artificial sequence | |
| MG3-6_3-8 adenine base editor | | 1402 | 3-68_DIV30M_CMCL68 | Protein | artificial sequence | |
| MG3-6_3-8 adenine base editor | | 1403 | 3-68_DIV30M_CMCL69 | Protein | artificial sequence | |
| MG3-6_3-8 adenine base editor | | 1404 | 3-68_DIV30M_CMCL70 | Protein | artificial sequence | |
| MG3-6_3-8 adenine base editor | | 1405 | 3-68_DIV30M_CMCL71 | Protein | artificial sequence | |
| MG3-6_3-8 adenine base editor | | 1406 | 3-68_DIV30M_CMCL72 | Protein | artificial sequence | |
| MG3-6_3-8 adenine base editor | | 1407 | 3-68_DIV30M_CMCL73 | Protein | artificial sequence | |
| MG3-6_3-8 adenine base editor | | 1408 | 3-68_DIV30M_CMCL74 | Protein | artificial sequence | |
| MG3-6_3-8 adenine base editor | | 1409 | 3-68_DIV30M_CMCL75 | Protein | artificial sequence | |
| MG3-6_3-8 adenine base editor | | 1410 | 3-68_DIV30M | Protein | artificial sequence | |

TABLE 2-continued

| Category | Sequence Number | SEQ ID NO: | Description | Type | Organism | Other Information or Sequence |
|---|---|---|---|---|---|---|
| Sequence Listing of Protein and Nucleic Acid Sequences Referred to Herein | | | | | | |
| MG3-6_3-8 adenine base editor | | 1411 | 3-68_DIV30D | Protein | artificial sequence | |
| MG3-6_3-8 adenine base editor | | 1412 | 3-68_DIV30_M_EPMG68-4_D7G_D10G_B | Protein | artificial sequence | |
| MG3-6_3-8 adenine base editor | | 1413 | 3-68_DIV30_M_EPMG68-4_H129N_B | Protein | artificial sequence | |
| MG3-6_3-8 adenine base editor | | 1414 | 3-68_DIV30_HT_EPMG68-4_D109N + D7G-D10G_B | Protein | artificial sequence | |
| MG3-6_3-8 adenine base editor | | 1415 | 3-68_DIV30_HT_EPMG68-4_D109N + H129N B | Protein | artificial sequence | |
| MG34-1 adenine base editor sgRNA sequence | | 1416 | MG34-1_633 guide | Nucleotide | artificial sequence | |
| MG34-1 adenine base editor sgRNA sequence | | 1417 | MG34-1_634 guide | Nucleotide | artificial sequence | |
| MG3-6_3-8 adenine base editor sgRNA sequence | | 1418 | sgRNA68 | Nucleotide | artificial sequence | |
| MG34-1 adenine base editor target sequence | | 1419 | MG34-1_633 target sequence | Nucleotide | artificial sequence | |
| MG34-1 adenine base editor target sequence | | 1420 | MG34-1_634 target sequence | Nucleotide | artificial sequence | |
| MG3-6_3-8 adenine base editor target sequence | | 1421 | sgRNA68 target sequence | Nucleotide | artificial sequence | |
| Plasmid | | 1422 | Expression of MG34-1 adenine base editor, pPE798 | Nucleotide | artificial sequence | |
| Plasmid | | 1423 | Expression of MG3-6_3-8 adenine base editor, pPE1159 | Nucleotide | artificial sequence | |
| MG35-1 adenine base editor | | 1424 | MG35-1 ABE | Protein | artificial sequence | |
| Plasmid, MG35-1 adenine | | 1425 | Expression of MG35-1 ABE and sgRNA targeting the CAT gene | Nucleotide | artificial sequence | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| base editor construct with sgRNA and CAT gene | | | | | | |
| Plasmid, MG35-1 adenine base editor construct with sgRNA and CAT gene | | 1426 | Expression of MG35-1 ABE and sgRNA with a scrabled spacer that cannot target the CAT gene | Nucleotide | artificial sequence | |
| MG35-1 sgRNA | | 1427 | MG35-1 sgRNA with spacer targeting CAT gene | Nucleotide | artificial sequence | |
| MG35-1 sgRNA | | 1428 | MG35-1 sgRNA with scrambled version of spacer targeting CAT gene | Nucleotide | artificial sequence | |
| MG35-1 target sequence | | 1429 | MG35-1 CAT gene target sequence | Nucleotide | artificial sequence | |
| MG35-1 target sequence | | 1430 | MG35-1 CAT gene scrambled target sequence | Nucleotide | artificial sequence | |
| MG3-6/3-8 APOA1 sgRNA | | 1431 | MG3-6/3-8 mApoa1 BE F12 | | N.A. | |
| MG3-6/3-8 APOA1 sgRNA | | 1432 | MG3-6/3-8 mApoa1 BE D11 | | N.A. | |
| MG3-6/3-8 APOA1 sgRNA | | 1433 | MG3-6/3-8 mApoa1 BE C5 | | N.A. | |
| MG3-6/3-8 APOA1 sgRNA | | 1434 | MG3-6/3-8 mApoa1 BE A4 | | N.A. | |
| MG3-6/3-8 APOA1 sgRNA | | 1435 | MG3-6/3-8 mApoa1 BE F4 | | N.A. | |
| MG3-6/3-8 APOA1 sgRNA | | 1436 | MG3-6/3-8 mApoa1 BE A5 | | N.A. | |
| MG3-6/3-8 APOA1 sgRNA | | 1437 | MG3-6/3-8 mApoa1 BE E12 | | N.A. | |
| MG3-6/3-8 APOA1 sgRNA | | 1438 | MG3-6/3-8 mApoa1 BE A11 | | N.A. | |
| MG3-6/3-8 APOA1 sgRNA | | 1439 | MG3-6/3-8 mApoa1 BE B4 | | N.A. | |
| MG3-6/3-8 APOA1 sgRNA | | 1440 | MG3-6/3-8 mApoa1 BE G4 | | N.A. | |
| MG3-6/3-8 APOA1 sgRNA | | 1441 | MG3-6/3-8 mApoa1 BE B2 | | N.A. | |

TABLE 2-continued

| Category | Sequence Number | SEQ ID NO: | Description | Type | Organism | Other Information or Sequence |
|---|---|---|---|---|---|---|
| Sequence Listing of Protein and Nucleic Acid Sequences Referred to Herein | | | | | | |
| MG3-6/3-8 APOA1 sgRNA | | 1442 | MG3-6/3-8 mApoa1 BE D7 | | N.A. | |
| MG3-6/3-8 APOA1 sgRNA | | 1443 | MG3-6/3-8 mApoa1 BE B5 | | N.A. | |
| MG3-6/3-8 APOA1 sgRNA | | 1444 | MG3-6/3-8 mApoa1 BE G6 | | N.A. | |
| MG3-6/3-8 APOA1 sgRNA | | 1445 | MG3-6/3-8 mApoa1 BE A8 | | N.A. | |
| MG3-6/3-8 APOA1 sgRNA | | 1446 | MG3-6/3-8 mApoa1 BE F2 | | N.A. | |
| MG3-6/3-8 APOA1 sgRNA | | 1447 | MG3-6/3-8 mApoa1 BE E1 | | N.A. | |
| MG3-6/3-8 APOA1 sgRNA | | 1448 | MG3-6/3-8 mApoa1 BE B8 | | N.A. | |
| MG3-6/3-8 APOA1 sgRNA | | 1449 | MG3-6/3-8 mApoa1 BE H8 | | N.A. | |
| MG3-6/3-8 APOA1 sgRNA | | 1450 | MG3-6/3-8 mApoa1 BE H6 | | N.A. | |
| MG3-6/3-8 APOA1 sgRNA | | 1451 | MG3-6/3-8 mApoa1 BE F5 | | N.A. | |
| MG3-6/3-8 APOA1 sgRNA | | 1452 | MG3-6/3-8 mApoa1 BE H3 | | N.A. | |
| MG3-6/3-8 APOA1 sgRNA | | 1453 | MG3-6/3-8 mApoa1 BE H4 | | N.A. | |
| MG3-6/3-8 APOA1 sgRNA | | 1454 | MG3-6/3-8 mApoa1 BE E8 | | N.A. | |
| MG3-6/3-8 APOA1 target sequence | | 1455 | MG3-6/3-8 mApoa1 BE F12 | | N.A. | |
| MG3-6/3-8 APOA1 target sequence | | 1456 | MG3-6/3-8 mApoa1 BE D11 | | N.A. | |
| MG3-6/3-8 APOA1 target sequence | | 1457 | MG3-6/3-8 mApoa1 BE C5 | | N.A. | |
| MG3-6/3-8 APOA1 target sequence | | 1458 | MG3-6/3-8 mApoa1 BE A4 | | N.A. | |
| MG3-6/3-8 | | 1459 | MG3-6/3-8 mApoa1 BE F4 | | N.A. | |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| APOA1 target sequence | | | | | | |
| MG3-6/3-8 APOA1 target sequence | | 1460 | MG3-6/3-8 mApoa1 BE A5 | | N.A. | |
| MG3-6/3-8 APOA1 target sequence | | 1461 | MG3-6/3-8 mApoa1 BE E12 | | N.A. | |
| MG3-6/3-8 APOA1 target sequence | | 1462 | MG3-6/3-8 mApoa1 BE A11 | | N.A. | |
| MG3-6/3-8 APOA1 target sequence | | 1463 | MG3-6/3-8 mApoa1 BE B4 | | N.A. | |
| MG3-6/3-8 APOA1 target sequence | | 1464 | MG3-6/3-8 mApoa1 BE G4 | | N.A. | |
| MG3-6/3-8 APOA1 target sequence | | 1465 | MG3-6/3-8 mApoa1 BE B2 | | N.A. | |
| MG3-6/3-8 APOA1 target sequence | | 1466 | MG3-6/3-8 mApoa1 BE D7 | | N.A. | |
| MG3-6/3-8 APOA1 target sequence | | 1467 | MG3-6/3-8 mApoa1 BE B5 | | N.A. | |
| MG3-6/3-8 APOA1 target sequence | | 1468 | MG3-6/3-8 mApoa1 BE G6 | | N.A. | |
| MG3-6/3-8 APOA1 target sequence | | 1469 | MG3-6/3-8 mApoa1 BE A8 | | N.A. | |
| MG3-6/3-8 APOA1 target sequence | | 1470 | MG3-6/3-8 mApoa1 BE F2 | | N.A. | |
| MG3-6/3-8 APOA1 target sequence | | 1471 | MG3-6/3-8 mApoa1 BE E1 | | N.A. | |
| MG3-6/3-8 APOA1 target sequence | | 1472 | MG3-6/3-8 mApoa1 BE B8 | | N.A. | |
| MG3-6/3-8 APOA1 target sequence | | 1473 | MG3-6/3-8 mApoa1 BE H8 | | N.A. | |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG3-6/3-8 APOA1 target sequence | | 1474 | MG3-6/3-8 mApoa1 BE H6 | | N.A. | |
| MG3-6/3-8 APOA1 target sequence | | 1475 | MG3-6/3-8 mApoa1 BE F5 | | N.A. | |
| MG3-6/3-8 APOA1 target sequence | | 1476 | MG3-6/3-8 mApoa1 BE H3 | | N.A. | |
| MG3-6/3-8 APOA1 target sequence | | 1477 | MG3-6/3-8 mApoa1 BE H4 | | N.A. | |
| MG3-6/3-8 APOA1 target sequence | | 1478 | MG3-6/3-8 mApoa1 BE E8 | | N.A. | |
| MG3-6/3-8 ANGPTL3 sgRNA | | 1479 | MG3-6/3-8 mAngptl3 BE C12 | | N.A. | |
| MG3-6/3-8 ANGPTL3 sgRNA | | 1480 | MG3-6/3-8 mAngptl3 BE B2 | | N.A. | |
| MG3-6/3-8 ANGPTL3 sgRNA | | 1481 | MG3-6/3-8 mAngptl3 BE C1 | | N.A. | |
| MG3-6/3-8 ANGPTL3 sgRNA | | 1482 | MG3-6/3-8 mAngptl3 BE F3 | | N.A. | |
| MG3-6/3-8 ANGPTL3 sgRNA | | 1483 | MG3-6/3-8 mAngptl3 BE G1 | | N.A. | |
| MG3-6/3-8 ANGPTL3 target sequence | | 1484 | MG3-6/3-8 mAngptl3 BE C12 | | N.A. | |
| MG3-6/3-8 ANGPTL3 target sequence | | 1485 | MG3-6/3-8 mAngptl3 BE B2 | | N.A. | |
| MG3-6/3-8 ANGPTL3 target sequence | | 1486 | MG3-6/3-8 mAngptl3 BE C1 | | N.A. | |
| MG3-6/3-8 ANGPTL3 target sequence | | 1487 | MG3-6/3-8 mAngptl3 BE F3 | | N.A. | |
| MG3-6/3-8 ANGPTL3 target sequence | | 1488 | MG3-6/3-8 mAngptl3 BE G1 | | N.A. | |
| MG3-6/3-8 TRAC sgRNA | | 1489 | MG3-6/3-8 mTrac BE E1 | | N.A. | |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG3-6/3-8 TRAC sgRNA | | 1490 | MG3-6/3-8 mTrac BE D10 | | N.A. | |
| MG3-6/3-8 TRAC target sequence | | 1491 | MG3-6/3-8 mTrac BE E1 | | N.A. | |
| MG3-6/3-8 TRAC target sequence | | 1492 | MG3-6/3-8 mTrac BE D10 | | N.A. | |
| NGS primers for mApoa1 BE F12 | | 1493 | mApoa1 BE F12F | | N.A. | |
| NGS primers for mApoa1 BE D11 | | 1494 | mApoa1 BE D11F | | N.A. | |
| NGS primers for mApoa1 BE C5 | | 1495 | mApoa1 BE C5F | | N.A. | |
| NGS primers for mApoa1 BE A4 | | 1496 | mApoa1 BE A4F | | N.A. | |
| NGS primers for mApoa1 BE F4 | | 1497 | mApoa1 BE F4F | | N.A. | |
| NGS primers for mApoa1 BE A5 | | 1498 | mApoa1 BE A5F | | N.A. | |
| NGS primers for mApoa1 BE E12 | | 1499 | mApoa1 BE E12F | | N.A. | |
| NGS primers for mApoa1 BE A11 | | 1500 | mApoa1 BE A11F | | N.A. | |
| NGS primers for mApoa1 BE B4 | | 1501 | mApoa1 BE B4F | | N.A. | |
| NGS primers for mApoa1 BE G4 | | 1502 | mApoa1 BE G4F | | N.A. | |
| NGS primers for mApoa1 BE B2 | | 1503 | mApoa1 BE B2F | | N.A. | |
| NGS primers for mApoa1 BE D7 | | 1504 | mApoa1 BE D7F | | N.A. | |

TABLE 2-continued

| Category | Sequence Number | SEQ ID NO: | Description | Type | Organism | Other Information or Sequence |
|---|---|---|---|---|---|---|
| Sequence Listing of Protein and Nucleic Acid Sequences Referred to Herein | | | | | | |
| NGS primers for mApoa1 BE B5 | | 1505 | mApoa1 BE B5F | | N.A. | |
| NGS primers for mApoa1 BE G6 | | 1506 | mApoa1 BE G6F | | N.A. | |
| NGS primers for mApoa1 BE A8 | | 1507 | mApoa1 BE A8F | | N.A. | |
| NGS primers for mApoa1 BE F2 | | 1508 | mApoa1 BE F2F | | N.A. | |
| NGS primers for mApoa1 BE E1 | | 1509 | mApoa1 BE E1F | | N.A. | |
| NGS primers for mApoa1 BE B8 | | 1510 | mApoa1 BE B8F | | N.A. | |
| NGS primers for mApoa1 BE H8 | | 1511 | mApoa1 BE H8F | | N.A. | |
| NGS primers for mApoa1 BE H6 | | 1512 | mApoa1 BE H6F | | N.A. | |
| NGS primers for mApoa1 BE F5 | | 1513 | mApoa1 BE F5F | | N.A. | |
| NGS primers for mApoa1 BE H3 | | 1514 | mApoa1 BE H3F | | N.A. | |
| NGS primers for mApoa1 BE H4 | | 1515 | mApoa1 BE H4F | | N.A. | |
| NGS primers for mApoa1 BE E8 | | 1516 | mApoa1 BE E8F | | N.A. | |
| NGS primers for mAngptl3 BE C12 | | 1517 | mAngptl3 BE C12F | | N.A. | |
| NGS primers for mAngptl3 BE B2 | | 1518 | mAngptl3 BE B2F | | N.A. | |
| NGS primers for | | 1519 | mAngptl3 BE C1F | | N.A. | |

TABLE 2-continued

| Category | Sequence Number | SEQ ID NO: | Description | Type | Organism | Other Information or Sequence |
|---|---|---|---|---|---|---|
| mAngptl3 BE C1 | | | | | | |
| NGS primers for mAngptl3 BE F3 | | 1520 | mAngptl3 BE F3F | | N.A. | |
| NGS primers for mAngptl3 BE G1 | | 1521 | mAngptl3 BE G1F | | N.A. | |
| NGS primers for mTrac BE E1 | | 1522 | mTrac BE E1F | | N.A. | |
| NGS primers for mTrac BE D10 | | 1523 | mTrac BE D10F | | N.A. | |
| NGS primers for mApoa1 BE F12 | | 1524 | mApoa1 BE F12R | | N.A. | |
| NGS primers for mApoa1 BE D11 | | 1525 | mApoa1 BE D11R | | N.A. | |
| NGS primers for mApoa1 BE C5 | | 1526 | mApoa1 BE C5R | | N.A. | |
| NGS primers for mApoa1 BE A4 | | 1527 | mApoa1 BE A4R | | N.A. | |
| NGS primers for mApoa1 BE F4 | | 1528 | mApoa1 BE F4R | | N.A. | |
| NGS primers for mApoa1 BE A5 | | 1529 | mApoa1 BE A5R | | N.A. | |
| NGS primers for mApoa1 BE E12 | | 1530 | mApoa1 BE E12R | | N.A. | |
| NGS primers for mApoa1 BE A11 | | 1531 | mApoa1 BE A11R | | N.A. | |
| NGS primers for mApoa1 BE B4 | | 1532 | mApoa1 BE B4R | | N.A. | |
| NGS primers for mApoa1 BE G4 | | 1533 | mApoa1 BE G4R | | N.A. | |

Sequence Listing of Protein and Nucleic Acid Sequences Referred to Herein

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| NGS primers for mApoa1 BE B2 | | 1534 | mApoa1 BE B2R | | N.A. | |
| NGS primers for mApoa1 BE D7 | | 1535 | mApoa1 BE D7R | | N.A. | |
| NGS primers for mApoa1 BE B5 | | 1536 | mApoa1 BE B5R | | N.A. | |
| NGS primers for mApoa1 BE G6 | | 1537 | mApoa1 BE G6R | | N.A. | |
| NGS primers for mApoa1 BE A8 | | 1538 | mApoa1 BE A8R | | N.A. | |
| NGS primers for mApoa1 BE F2 | | 1539 | mApoa1 BE F2R | | N.A. | |
| NGS primers for mApoa1 BE E1 | | 1540 | mApoa1 BE E1R | | N.A. | |
| NGS primers for mApoa1 BE B8 | | 1541 | mApoa1 BE B8R | | N.A. | |
| NGS primers for mApoa1 BE H8 | | 1542 | mApoa1 BE H8R | | N.A. | |
| NGS primers for mApoa1 BE H6 | | 1543 | mApoa1 BE H6R | | N.A. | |
| NGS primers for mApoa1 BE F5 | | 1544 | mApoa1 BE F5R | | N.A. | |
| NGS primers for mApoa1 BE H3 | | 1545 | mApoa1 BE H3R | | N.A. | |
| NGS primers for mApoa1 BE H4 | | 1546 | mApoa1 BE H4R | | N.A. | |
| NGS primers for mApoa1 BE E8 | | 1547 | mApoa1 BE E8R | | N.A. | |
| NGS primers for | | 1548 | mAngptl3 BE C12R | | N.A. | |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| mAngptl 3 BE C12 | | | | | | |
| NGS primers for mAngptl 3 BE B2 | | 1549 | mAngptl3 BE B2R | | N.A. | |
| NGS primers for mAngptl 3 BE C1 | | 1550 | mAngptl3 BE C1R | | N.A. | |
| NGS primers for mAngptl 3 BE F3 | | 1551 | mAngptl3 BE F3R | | N.A. | |
| NGS primers for mAngptl 3 BE G1 | | 1552 | mAngptl3 BE G1R | | N.A. | |
| NGS primers for mTrac BE E1 | | 1553 | mTrac BE E1R | | N.A. | |
| NGS primers for mTrac BE D10 | | 1554 | mTrac BE D10R | | N.A. | |
| Plasmid | | 1555 | mRNA production | nucleotide | artificial sequence | |
| MG131 adenine deaminase variant | | 1556 | mutated adenine deaminase | protein | uncultivated organism | MG131-1v1 |
| MG131 adenine deaminase variant | | 1557 | mutated adenine deaminase | protein | uncultivated organism | MG131-2v2 |
| MG131 adenine deaminase variant | | 1558 | mutated adenine deaminase | protein | uncultivated organism | MG131-5v3 |
| MG131 adenine deaminase variant | | 1559 | mutated adenine deaminase | protein | uncultivated organism | MG131-6v4 |
| MG131 adenine deaminase variant | | 1560 | mutated adenine deaminase | protein | uncultivated organism | MG131-9v5 |
| MG131 adenine deaminase variant | | 1561 | mutated adenine deaminase | protein | uncultivated organism | MG131-7v6 |
| MG131 adenine deaminase variant | | 1562 | mutated adenine deaminase | protein | uncultivated organism | MG131-3v7 |
| MG134 adenine deaminase variant | | 1563 | mutated adenine deaminase | protein | uncultivated organism | MG134-1v1 |
| MG134 adenine deaminase variant | | 1564 | mutated adenine deaminase | protein | uncultivated organism | MG134-2v2 |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| MG134 adenine deaminase variant | | 1565 | mutated adenine deaminase | protein | uncultivated organism | MG134-3v3 |
| MG134 adenine deaminase variant | | 1566 | mutated adenine deaminase | protein | uncultivated organism | MG134-4v4 |
| MG135 adenine deaminase variant | | 1567 | mutated adenine deaminase | protein | uncultivated organism | MG135-1v1 |
| MG135 adenine deaminase variant | | 1568 | mutated adenine deaminase | protein | uncultivated organism | MG135v-2v2 |
| MG135 adenine deaminase variant | | 1569 | mutated adenine deaminase | protein | uncultivated organism | MG135-4v3 |
| MG135 adenine deaminase variant | | 1570 | mutated adenine deaminase | protein | uncultivated organism | MG135-5v4 |
| MG135 adenine deaminase variant | | 1571 | mutated adenine deaminase | protein | uncultivated organism | MG135-6v5 |
| MG135 adenine deaminase variant | | 1572 | mutated adenine deaminase | protein | uncultivated organism | MG135-8v6 |
| MG135 adenine deaminase variant | | 1573 | mutated adenine deaminase | protein | uncultivated organism | MG135-7v7 |
| MG135 adenine deaminase variant | | 1574 | mutated adenine deaminase | protein | uncultivated organism | MG135-3v8 |
| MG137 adenine deaminase variant | | 1575 | mutated adenine deaminase | protein | uncultivated organism | MG137-1v1 |
| MG137 adenine deaminase variant | | 1576 | mutated adenine deaminase | protein | uncultivated organism | MG137-2v2 |
| MG137 adenine deaminase variant | | 1577 | mutated adenine deaminase | protein | uncultivated organism | MG137-4v3 |
| MG137 adenine deaminase variant | | 1578 | mutated adenine deaminase | protein | uncultivated organism | MG137-6v4 |
| MG137 adenine deaminase variant | | 1579 | mutated adenine deaminase | protein | uncultivated organism | MG137-17v5 |
| MG137 adenine deaminase variant | | 1580 | mutated adenine deaminase | protein | uncultivated organism | MG137-9v6 |
| MG137 adenine deaminase variant | | 1581 | mutated adenine deaminase | protein | uncultivated organism | MG137-11v7 |
| MG137 adenine deaminase variant | | 1582 | mutated adenine deaminase | protein | uncultivated organism | MG137-12v8 |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG137 adenine deaminase variant | | 1583 | mutated adenine deaminase | protein | uncultivated organism | MG137-13v9 |
| MG137 adenine deaminase variant | | 1584 | mutated adenine deaminase | protein | uncultivated organism | MG137-15v10 |
| MG137 adenine deaminase variant | | 1585 | mutated adenine deaminase | protein | uncultivated organism | MG137-5v11 |
| MG137 adenine deaminase variant | | 1586 | mutated adenine deaminase | protein | uncultivated organism | MG137-14v12 |
| MG137 adenine deaminase variant | | 1587 | mutated adenine deaminase | protein | uncultivated organism | MG137-16v13 |
| MG137 adenine deaminase variant | | 1588 | mutated adenine deaminase | protein | uncultivated organism | MG137-8v14 |
| MG137 adenine deaminase variant | | 1589 | mutated adenine deaminase | protein | uncultivated organism | MG137-3v15 |
| MG68 adenine deaminase variant | | 1590 | mutated adenine deaminase | protein | uncultivated organism | MG68-55v1 |
| MG68 adenine deaminase variant | | 1591 | mutated adenine deaminase | protein | uncultivated organism | MG68-27v2 |
| MG68 adenine deaminase variant | | 1592 | mutated adenine deaminase | protein | uncultivated organism | MG68-52v3 |
| MG68 adenine deaminase variant | | 1593 | mutated adenine deaminase | protein | uncultivated organism | MG68-15v4 |
| MG68 adenine deaminase variant | | 1594 | mutated adenine deaminase | protein | uncultivated organism | MG68-58v5 |
| MG68 adenine deaminase variant | | 1595 | mutated adenine deaminase | protein | uncultivated organism | MG68-25v6 |
| MG68 adenine deaminase variant | | 1596 | mutated adenine deaminase | protein | uncultivated organism | MG68-18v7 |
| MG68 adenine deaminase variant | | 1597 | mutated adenine deaminase | protein | uncultivated organism | MG68-45v8 |
| MG68 adenine deaminase variant | | 1598 | mutated adenine deaminase | protein | uncultivated organism | MG68-13v9 |
| MG68 adenine deaminase variant | | 1599 | mutated adenine deaminase | protein | uncultivated organism | MG68-4v10 |
| MG132 adenine deaminase variant | | 1600 | mutated adenine deaminase | protein | uncultivated organism | MG132-1v1 |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG132 adenine deaminase variant | | 1601 | mutated adenine deaminase | protein | uncultivated organism | MG132-1v2 |
| MG132 adenine deaminase variant | | 1602 | mutated adenine deaminase | protein | uncultivated organism | MG132-1v3 |
| MG133 adenine deaminase variant | | 1603 | mutated adenine deaminase | protein | uncultivated organism | MG133-1v1 |
| MG133 adenine deaminase variant | | 1604 | mutated adenine deaminase | protein | uncultivated organism | MG133-2v2 |
| MG133 adenine deaminase variant | | 1605 | mutated adenine deaminase | protein | uncultivated organism | MG133-7v3 |
| MG133 adenine deaminase variant | | 1606 | mutated adenine deaminase | protein | uncultivated organism | MG133-4v4 |
| MG133 adenine deaminase variant | | 1607 | mutated adenine deaminase | protein | uncultivated organism | MG133-12v5 |
| MG133 adenine deaminase variant | | 1608 | mutated adenine deaminase | protein | uncultivated organism | MG133-5v6 |
| MG133 adenine deaminase variant | | 1609 | mutated adenine deaminase | protein | uncultivated organism | MG133-9v7 |
| MG133 adenine deaminase variant | | 1610 | mutated adenine deaminase | protein | uncultivated organism | MG133-14v8 |
| MG133 adenine deaminase variant | | 1611 | mutated adenine deaminase | protein | uncultivated organism | MG133-8v9 |
| MG133 adenine deaminase variant | | 1612 | mutated adenine deaminase | protein | uncultivated organism | MG133-10v10 |
| MG133 adenine deaminase variant | | 1613 | mutated adenine deaminase | protein | uncultivated organism | MG133-13v11 |
| MG133 adenine deaminase variant | | 1614 | mutated adenine deaminase | protein | uncultivated organism | MG133-3v12 |
| MG133 adenine deaminase variant | | 1615 | mutated adenine deaminase | protein | uncultivated organism | MG133-6v13 |
| MG133 adenine deaminase variant | | 1616 | mutated adenine deaminase | protein | uncultivated organism | MG133-11v14 |
| MG136 adenine deaminase variant | | 1617 | mutated adenine deaminase | protein | uncultivated organism | MG136-1v1 |
| MG136 adenine deaminase variant | | 1618 | mutated adenine deaminase | protein | uncultivated organism | MG136-6v2 |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG136 adenine deaminase variant | | 1619 | mutated adenine deaminase | protein | uncultivated organism | MG136-12v3 |
| MG136 adenine deaminase variant | | 1620 | mutated adenine deaminase | protein | uncultivated organism | MG136-2v4 |
| MG136 adenine deaminase variant | | 1621 | mutated adenine deaminase | protein | uncultivated organism | MG136-3v5 |
| MG136 adenine deaminase variant | | 1622 | mutated adenine deaminase | protein | uncultivated organism | MG136-9v6 |
| MG136 adenine deaminase variant | | 1623 | mutated adenine deaminase | protein | uncultivated organism | MG136-10v7 |
| MG136 adenine deaminase variant | | 1624 | mutated adenine deaminase | protein | uncultivated organism | MG136-11v8 |
| MG129 adenine deaminase variant | | 1625 | mutated adenine deaminase | protein | uncultivated organism | MG129-1v1 |
| MG129 adenine deaminase variant | | 1626 | mutated adenine deaminase | protein | uncultivated organism | MG129-2v2 |
| MG129 adenine deaminase variant | | 1627 | mutated adenine deaminase | protein | uncultivated organism | MG129-11v3 |
| MG129 adenine deaminase variant | | 1628 | mutated adenine deaminase | protein | uncultivated organism | MG129-3v4 |
| MG129 adenine deaminase variant | | 1629 | mutated adenine deaminase | protein | uncultivated organism | MG129-7v5 |
| MG129 adenine deaminase variant | | 1630 | mutated adenine deaminase | protein | uncultivated organism | MG129-4v6 |
| MG129 adenine deaminase variant | | 1631 | mutated adenine deaminase | protein | uncultivated organism | MG129-9v7 |
| MG129 adenine deaminase variant | | 1632 | mutated adenine deaminase | protein | uncultivated organism | MG129-10v8 |
| MG129 adenine deaminase variant | | 1633 | mutated adenine deaminase | protein | uncultivated organism | MG129-12v9 |
| MG130 adenine deaminase variant | | 1634 | mutated adenine deaminase | protein | uncultivated organism | MG130-3v1 |
| MG130 adenine deaminase variant | | 1635 | mutated adenine deaminase | protein | uncultivated organism | MG130-1v2 |
| MG130 adenine deaminase variant | | 1636 | mutated adenine deaminase | protein | uncultivated organism | MG130-5v3 |

TABLE 2-continued

Sequence Listing of Protein and Nucleic Acid Sequences Referred to Herein

| Category | Sequence Number | SEQ ID NO: | Description | Type | Organism | Other Information or Sequence |
|---|---|---|---|---|---|---|
| MG130 adenine deaminase variant | | 1637 | mutated adenine deaminase | protein | uncultivated organism | MG130-2v4 |
| MG130 adenine deaminase variant | | 1638 | mutated adenine deaminase | protein | uncultivated organism | MG130-4v5 |
| MG34-1 adenine base editor | | 1639 | MG68-4_nMG34-1 (D10A) | Protein | artificial sequence | |
| MG34-1 adenine base editor | | 1640 | MG68-4 (D109Q)_nMG34-1 (D10A) | Protein | artificial sequence | |
| MG34-1 adenine base editor | | 1641 | MG68-4 (D109N/H129N)_nMG34-1 (D10A) | Protein | artificial sequence | |
| MG34-1 adenine base editor | | 1642 | MG68-4 (D109Q/H129N)_nMG34-1 (D10A) | Protein | artificial sequence | |
| MG34-1 adenine base editor | | 1643 | MG68-4 (D7G/E10G/D109N)_nMG34-1 (D10A) | Protein | artificial sequence | |
| MG34-1 adenine base editor | | 1644 | MG68-4 (D7G/E10G/D109Q)_nMG34-1 (D10A) | Protein | artificial sequence | |
| RF253 | | 1645 | ssDNA substrate for testing ADA in vitro | DNA | artificial sequence | |
| RF278 | | 1646 | ssDNA substrate for testing ADA in vitro | DNA | artificial sequence | |
| MG effectors | | 1647 | MG3-6/3-8 effector | protein | unknown | MSTDMKNYRIG VDVGDRSVGL AAIEFDDDGLPI QKLALVTFRHD GGLDPTKNKTP MSRKETRGIAR RTMRMNRERK RRLRNLDNVLE NLGYSVPEGPE PETYEAWTSRA LLASIKLASADE LNEHLVRAVRH MARHRGWANP WWSLDQLEKA SQEPSETFEIILA RARELFGEKVP ANPTLGMLGAL AANNEVLLRPR DEKKRKTGYV RGTPLMFAQVR QGDQLAELRRI CEVQGIEDQYE ALRLGVFDHKH PYVPKERVGKD PLNPSTNRTIRA SLEFQEFRILDS VANLRVRIGSR AKRELTEAEYD AAVEFLMDYA DKEQPSWADV AEKIGVPGNRL VAPVLEDVQQK TAPYDRSSAAF EKAMGKKTEA RQWWESTDDD QLRSLLIAFLVD ATNDTEEAAAE AGLSELYKSWP |

TABLE 2-continued

| Category | Sequence Number | SEQ ID NO: | Description | Type | Organism | Other Information or Sequence |
|---|---|---|---|---|---|---|
| | | | | | | AEEREALSNIDF EKGRVAYSQET LSKLSEYMHEY RVGLHEARKA VFGVDDTWRPP LDKLEEPTGQP AVDRVLTILRR FVLDCERQWG RPRAITVEHTRT GLMGPTQRQKI LNEQKKNRAD NERIRDELRESG VDNPSRAEVRR HLIVQEQECQC LYCGTMITTTTS ELDHIVPRAGG GSSRRENLAAV CRACNAKKKR ELFYAWAGPV KSQETIERVRQL KAFKDSKKAK MFKNQIRRLNQ TEADEPIDERSL ASTSYAAVAVR ERLEQHFNEGL ALDDKSRVVLD VYAGAVTRESR RAGGIDERILLR GERDKNRFDVR HHAVDAAVMT LLNRSVALTLE QRSQLRRAFYE QGLDKLDRDQL KPEEDWRNFIG LSLASQEKFLE WKKVTTVLGD LLAEAIEDDSIA VVSPLRLRPQN GRVHKDTIAAV KKQTLGSAWS ADAVKRIVDPEI YLAMKDALGK SKVLPEDSART LELSDGRYLEA DDEVLFFPKNA ASILTPRGVAEI GGSIHHARLYS WLTKKGELKIG MLRVYGAEFP WLMRESGSHD VLRMPIHPGSQ SFRDMQDTTRK AVESSEAVEFA WITQNDELEFE PEDYIAHGGKD ELRQFLEFMPE CRWRVDGFKK NYQIRIRPAMLS REQLPSDIQRRL ESKTLTENESLL LKALDTGLVVA IGGLLPLGTLKV IRRNNLGFPRW RGNGNLPTSFE VRSSALRALGV EG |
| MG effectors sgRNA | | 1648 | MG3-6/3-8 effector sgRNA | RNA | synthetic | NNNNNNNNNN NNNNNNNNNN NNGTTGAGAA TCGAAAGATTC TTAATAAGGCA TCCTTCCGATG CTGACTTCTCA CCGTCCGTTTT |

TABLE 2-continued

| Sequence Listing of Protein and Nucleic Acid Sequences Referred to Herein | | | | | | |
|---|---|---|---|---|---|---|
| Category | Sequence Number | SEQ ID NO: | Description | Type | Organism | Other Information or Sequence |
| | | | | | | CCAATAGGAG CGGGCGGTAT GTTTT |

EXAMPLES

Example 1—Plasmid Construction for Base Editors

To create base editing enzymes that utilize CRISPR functionality to target their base editing, effector enzymes were fused in various configurations to the exemplary deaminases described herein. This process involved a first stage of constructing vectors suitable for generating the fusion enzymes. Two entry plasmid vectors, MGA, and MGC, were first constructed.

Figure 3:
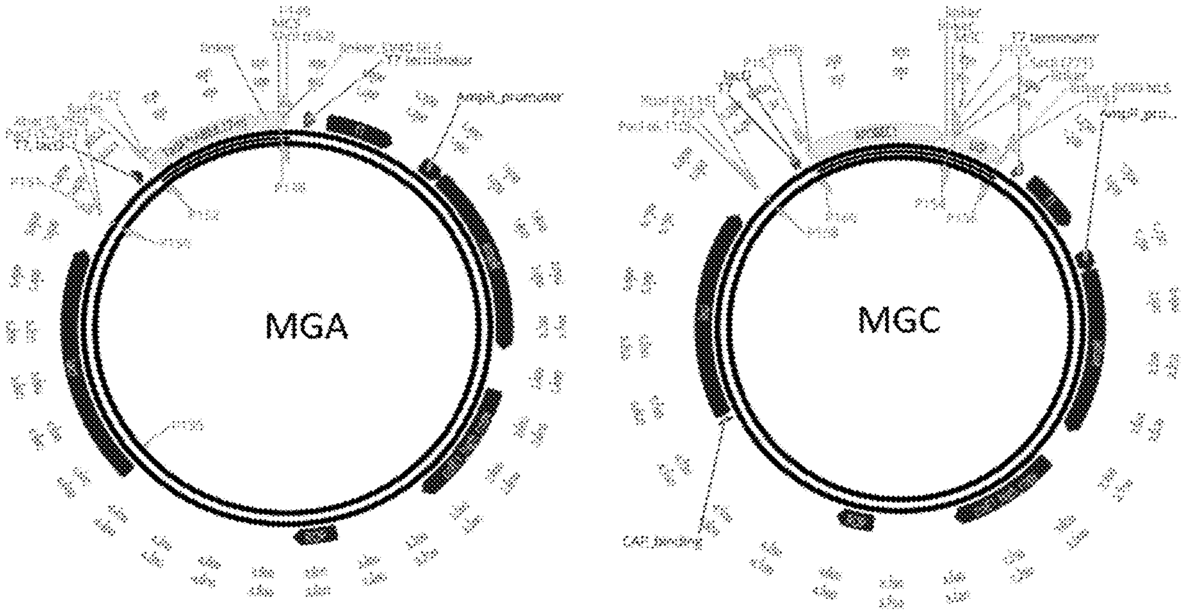
FIG. 3 (SEQ ID NO: 1874) shows plasmid maps for systems described herein. MGA contains TadA*(from ABE8.17m)-SV40 NLS and MGC contains APOBEC1 (from BE3) linked to a uracil glycosylase inhibitor and an SV40 NLS.

To construct the MGA (Metagenomi adenine base editor) entry plasmid containing T7 promoter-His tag-TadA* (ABE8.17m)-SV40 NLS, three DNA fragments were amplified from pAL6. To construct the MGC (Metagenomi cytosine base editor) entry plasmid containing T7 promoter-His tag-APOBEC1(BE3)-UGI-SV40 NLS, APOBEC1 and UGI-SV40 NLS were amplified from pAL9 and two pieces of vector backbones were amplified from pAL6 (see FIG. 3).

To introduce mutations into the effectors, source plasmids containing MG1-4, MG1-6, MG3-6, MG3-7, MG3-8, MG4-5, MG14-1, MG15-1, or MG18-1 effector gene sequences were amplified by Q5® DNA polymerase with forward primers incorporating appropriate mutations and reverse primers. The linear DNA fragments were then phosphorylated and ligated. The DNA templates were digested with DpnI using KLD Enzyme Mix (New England Biolabs) per the manufacturer's instructions.

Figure 2:
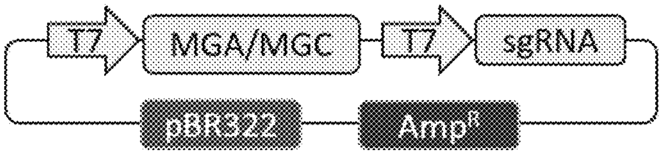
FIG. 2 shows the structure of a base editor plasmid containing a T7 promoter driving expression of the systems described herein.

To generate the pMGA and pMGC expression plasmids, genes were amplified from plasmids carrying mutated effectors and cloned into MGA and MGC entry plasmids via XhoI and SacII sites, respectively. To clone sgRNA expression cassettes comprising T7 promoter-sgRNA-bidirectional terminator into BE expression plasmids, one set of primers (P366 as the forward primer) was used to amplify a T7 promoter-spacer sequence while another set of primers (P367 as the reverse primer) was used to amplify spacer sequence-sgRNA scaffold-bidirectional terminator, in which pTCM plasmids were used as templates (see FIG. 2). The two fragments were assembled into pMGA and pMGC via XbaI sites, resulting pMGA-sgRNA and pMGC-sgRNA, respectively.

TABLE 3

| Summary of constructs made for ABE screening systems described herein | | |
|---|---|---|
| # | Application | Candidate |
| 1 | ABE | MGA1-4-sgRNA1 |
| 2 | | MGA1-4-sgRNA2 |
| 3 | | MGA1-4-sgRNA3 |
| 4 | | MGA1-6-sgRNA1 |
| 5 | | MGA1-6-sgRNA2 |
| 6 | | MGA1-6-sgRNA3 |
| 7 | | MGA3-6-sgRNA1 |

TABLE 3-continued

| Summary of constructs made for ABE screening systems described herein | | |
|---|---|---|
| # | Application | Candidate |
| 8 | | MGA3-6-sgRNA2 |
| 9 | | MGA3-6-sgRNA3 |
| 10 | | MGA3-7-sgRNA1 |
| 11 | | MGA3-7-sgRNA2 |
| 12 | | MGA3-7-sgRNA3 |
| 13 | | MGA3-8-sgRNA1 |
| 14 | | MGA3-8-sgRNA2 |
| 15 | | MGA3-8-sgRNA3 |
| 16 | | MGA14-1-sgRNA1 |
| 17 | | MGA14-1-sgRNA2 |
| 18 | | MGA14-1-sgRNA3 |
| 19 | | MGA15-1-sgRNA1 |
| 20 | | MGA15-1-sgRNA2 |
| 21 | | MGA15-1-sgRNA3 |
| 22 | | MGA18-1-sgRNA1 |
| 23 | | MGA18-1-sgRNA2 |
| 24 | | MGA18-1-sgRNA3 |
| 25 | | ABE8.17m-sgRNA1 |
| 26 | | ABE8.17m-sgRNA2 |
| 27 | | ABE8.17m-sgRNA3 |
| 28 | CBE | MGC1-4-sgRNA1 |
| 29 | | MGC1-4-sgRNA2 |
| 30 | | MGC1-4-sgRNA3 |
| 31 | | MGC1-6-sgRNA1 |
| 32 | | MGC1-6-sgRNA2 |
| 33 | | MGC1-6-sgRNA3 |
| 34 | | MGC3-6-sgRNA1 |
| 35 | | MGC3-6-sgRNA2 |
| 36 | | MGC3-6-sgRNA3 |
| 37 | | MGC3-7-sgRNA1 |
| 38 | | MGC3-7-sgRNA2 |
| 39 | | MGC3-7-sgRNA3 |
| 40 | | MGC3-8-sgRNA1 |
| 41 | | MGC3-8-sgRNA2 |
| 42 | | MGC3-8-sgRNA3 |
| 43 | | MGC4-5-sgRNA1 |
| 44 | | MGC4-5-sgRNA2 |
| 45 | | MGC4-5-sgRNA3 |
| 46 | | MGC14-1-sgRNA1 |
| 47 | | MGC14-1-sgRNA2 |
| 48 | | MGC14-1-sgRNA3 |
| 49 | | MGC15-1-sgRNA1 |
| 50 | | MGC15-1-sgRNA2 |
| 51 | | MGC15-1-sgRNA3 |
| 52 | | MGC18-1-sgRNA1 |
| 53 | | MGC18-1-sgRNA2 |
| 54 | | MGC18-1-sgRNA3 |
| 55 | | BE3-sgRNA1 |
| 56 | | BE3-sgRNA2 |
| 57 | | BE3-sgRNA3 |

Figure 4:
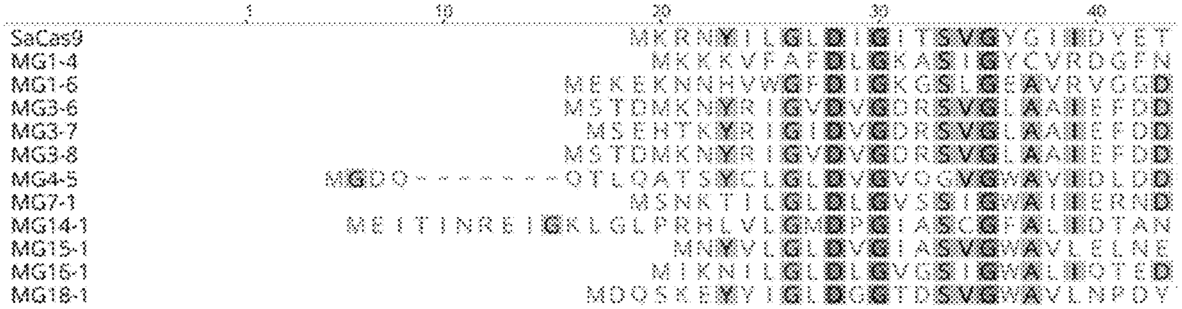
FIG. 4 (SEQ ID NOs: 1656-1667) shows predicted catalytic residues in the RuvCI domains of selected endonucleases described herein which are mutated to disrupt nuclease activity to generate nickase enzymes.
Figure 5:
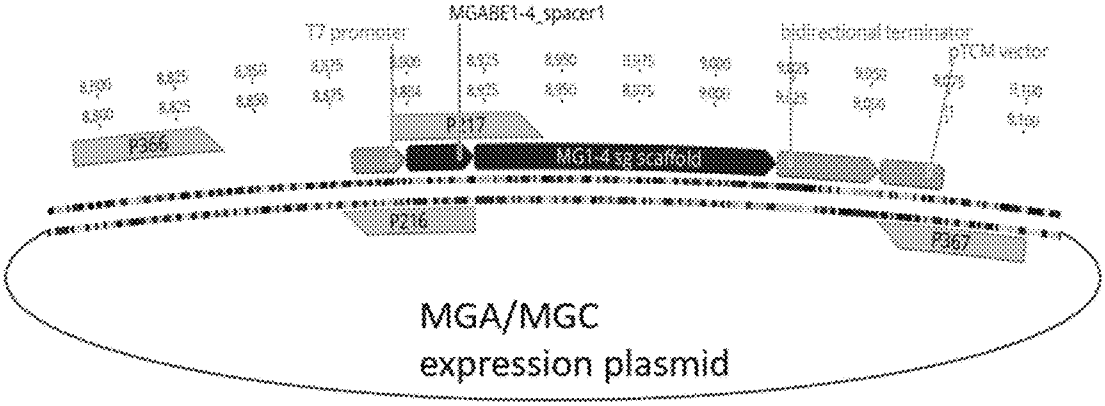
FIG. 5 depicts an example method for cloning a single guide RNA expression cassette into the systems described herein. One fragment comprises a T7 promoter plus spacer. The other fragment comprises spacer plus single guide scaffold sequence plus bidirectional terminator. The fragments are assembled into expression plasmids, resulting in functional constructs that can simultaneously express sgRNAs and base editors.

All amplified DNA fragments were purified by QIAquick® Gel Extraction Kit (Qiagen), assembled via NEBuilder® HiFi DNA Assembly (New England Biolabs), and the resulting assemblies were propagated via Endura Electrocompetent cells (Lucergen) per the manufacturer's instructions (see FIGS. 4 & 5). The DNA sequences of all cloned genes were confirmed at ELIM BIOPHARM.

TABLE 4

| Conserved catalytic residues parsed out for selected systems described herein | | |
|---|---|---|
| Nickase Candidate | Length | Associated Full-length Protein Sequence |
| nMG1-4 (D9A) | 1025 | SEQ ID NO: 70 |
| nMG1-6 (D13A) | 1059 | SEQ ID NO: 71 |
| nMG3-6 (D13A) | 1134 | SEQ ID NO: 72 |
| nMG3-7 (D12A) | 1131 | SEQ ID NO: 73 |
| nMG3-8 (D13A) | 1132 | SEQ ID NO: 74 |
| nMG4-5 (D17A) | 1055 | SEQ ID NO: 75 |
| nMG14-1 (D23A) | 1003 | SEQ ID NO: 76 |
| nMG15-1 (D8A) | 1082 | SEQ ID NO: 77 |
| nMG18-1 (D12A) | 1348 | SEQ ID NO: 78 |

Example 2—Protein Expression and Purification

Figure 7:
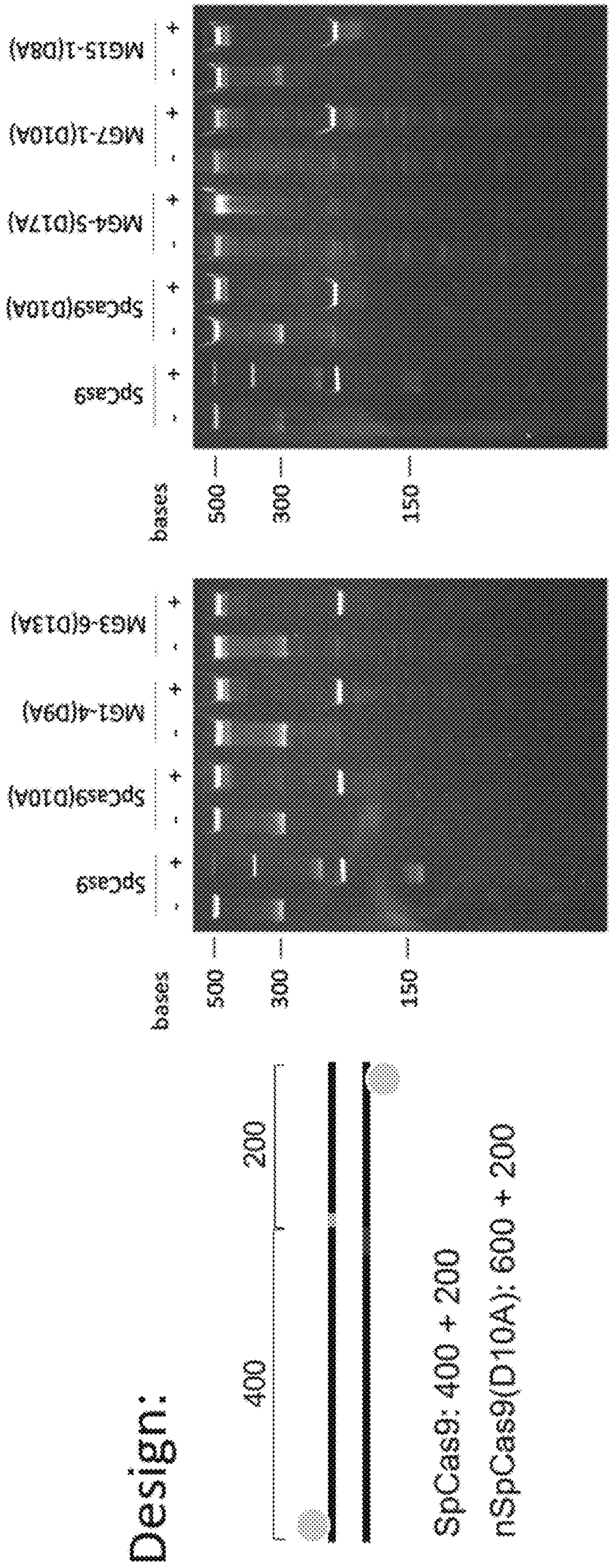
FIG. 7 shows the nickase activity of selected mutated effectors. 600 bp double-stranded DNA fragments labeled with a fluorophore (6-FAM) on both 5' ends were incubated with purified enzymes supplemented with their cognate sgRNAs. The reaction products were resolved on a 10% TBE-Urea denaturing gel. Double-stranded cleavage yields bands of 400 and 200 bases. Nickase activity yields bands of 600 and 200 bases.

The T7 promoter driven mutated effector genes in the pMGA and pMGC plasmids were expressed in *E. coli* BL21 (DE3) cells in Magic Media™ per manufacturer's instructions (Thermo) by transformation with each of the respective plasmids described in Example 1 above. After a 40 hour incubation at 16° C. the transformed cells were harvested, suspended in lysis buffer (HisTrap equilibration buffer: 20 mM Tris (Sigma T2319-100 ML), 300 mM sodium chloride (VWR VWRVE529-500 ML), 5% glycerol, 10 mM $MgCl_2$, with 10 mM imidazole (Sigma 68268-100 ML-F); pH 7.5) and EDTA-free protease inhibitor (Pierce), and frozen in the −80° C. freezer. The cells were then thawed on ice, sonicated, clarified, and filtered before affinity purification. The protein was applied to Cytiva 5 ml HisTrap FF column on the Akta Avant™ FPLC per the manufacturer's specifications and the protein was eluted in an isocratic elution of 20 mM Tris (Sigma T2319-100 ML), 300 mM sodium chloride (VWR VWRVE529-500 ML), 5% glycerol, 10 mM $MgCl_2$, with 250 mM imidazole (Sigma 68268-100 ML-F); pH 7.5. Eluted fractions containing the His-tagged effector proteins were concentrated and buffer exchanged into 50 mM Tris-HCl, 300 mM NaCl, 1 mM TCEP, 5% glycerol; pH 7.5. The protein concentration was determined by bicinchoninic acid assay (Thermo) and adjusted after determining the relative purity by SDS PAGE densitometry in Image Lab™ (Bio-Rad) (see FIG. 7).

Example 3—In Vitro Nickase Assay 6-carboxyfluorescein (6-FAM) labeled primers P141 and P146 (SEQ ID NOs: 179 and 180) synthesized by IDT were used to amplify linear fragments of LacZ containing targeting sequences of effectors using Q5® DNA polymerase. DNA fragments containing the T7 promoter followed by sgRNAs containing 20-bp or 22-bp spacer sequences were transcribed in vitro using HiScribe® T7 High Yield RNA Synthesis Kit (New England Biolabs) per manufacturer's instructions. Synthetic sgRNAs with the sequences corresponding to the named sgRNAs in the sequence listing were purified by Monarch® RNA Cleanup Kit (New England Biolabs) according to the users manual and concentrations were measured by Nanodrop.

To determine DNA nickase activity, each of the purified mutated effectors was first supplemented with its cognate sgRNA. Reactions were initiated by adding the linear DNA substrate in a 15 μL reaction mixture containing 10 mM Tris pH 7.5, 10 mM $MgCl_2$, and 100 mM NaCl, 150 nM enzyme, 150 nM RNA, and 15 nM DNA. The reaction was incubated at 37° C. for 2 h. Digested DNA was purified using AMPure XP SPRI paramagnetic beads (Beckman Coulter) and eluted with 6 μL TE buffer (10 mM Tris, 1 mM EDTA; pH 8.0). The nicked DNA was resolved on a 10% TBE-Urea denaturing gel (Biorad) and imaged by ChemiDoc™ (Bio-Rad) (see FIG. 7, which shows that the depicted enzymes display nickase activity by production of bands 600 and 200 bases versus 400 and 200 bases in the case of the wild-type enzyme). The results indicated that all the tested nickase mutants in FIG. 7 displayed their expected nickase activity instead of wild type cleavage activity with the exception of MG4-5 (D17A), which was inconclusive.

Example 4—Base Editor Introduction into *E. coli*

Plasmids were transformed into Lucergen's electrocompetent BL21(DE3) cells according to the manufacturer's instructions. After electroporation, cells were recovered with expression recovery media at 37° C. for 1 h and spread on LB plates containing 100 L/mg ampicillin and 0.1 mM IPTG. After overnight growth at 37° C., colonies were picked and lacZ gene was amplified by Q5® DNA polymerase (New England Biolabs) with primers P137 and P360. The resulting PCR products were purified and sequenced by Sanger sequencing at ELIM BIOPHARM. Base edits were determined by examining whether there exists C to T conversion or A to G conversion in the targeted protospacer regions for cytosine base editors or adenine base editors, respectively.

To evaluate editing efficiency in *E. coli*, plasmids were transformed into electrocompetent BL21(DE3) (Lucergen) and the electroporated cells were recovered with expression recovery media at 37° C. for 1 h. 10 μL of recovered cells were then inoculated into 990 μL SOB containing 100 μL/mg ampicillin and 0.1 mM IPTG in a 96-well deep well plate, and grown at 37° C. for 20 h. 1 μL cells induced for base editor expression were used for amplification of the lacZ gene in a 20 μL PCR reaction (Q5® DNA polymerase) with primers P137 and P360. The resulting PCR products were purified and sequenced by Sanger sequencing at ELIM BIOPHARM. Quantification of editing efficiency was processed by Edit R as described in Example 12.

TABLE 5

| The MG base editors described herein with associated PAM and deaminases | | | | | | | |
|---|---|---|---|---|---|---|---|
| Candidate | Type | PAM | Deaminase | Linker (Deaminase-Nickase) | Nickase | UGI | Linker (Nickase-UGI) |
| MGA1-4 | II | nRRR Sequence Number: A360 | TadA* (ABE8.17m) SEQ ID NO: 595 | SGGSSGGSSGSE TPGTSESATPESS GGSSGGS (SEQ ID NO: 592) | nMG1-4 (D9A) SEQ ID NO: 70 | — | |

TABLE 5-continued

The MG base editors described herein with associated PAM and deaminases

| Candidate | Type | PAM | Deaminase | Linker (Deaminase-Nickase) | Nickase | UGI | Linker (Nickase-UGI) |
|---|---|---|---|---|---|---|---|
| MGA3-7 | II | nnRnYAY Sequence Number: A363 | TadA* (ABE8.17m) SEQ ID NO: 595 | SGGSSGGSSGSE TPGTSESATPESS GGSSGGS (SEQ ID NO: 592) | nMG3-7 (D12A) SEQ ID NO: 73 | — | |
| MGA18-1 | II | nRWART Sequence Number: A368 | TadA* (ABE8.17m) SEQ ID NO: 595 | SGGSSGGSSGSE TPGTSESATPESS GGSSGGS (SEQ ID NO: 592) | nMG18-1 (D12A) SEQ ID NO: 78 | — | |
| MGC1-6 | II | nnRRAY Sequence Number: A361 | APOBEC1 (BE3) SEQ ID NO: 58 | SGSETPGTSESAT PESA (SEQ ID NO: 591) | nMG1-6 (D13A) SEQ ID NO: 71 | UGI (BE3) SEQ ID NO: 67 | GSGGS (SEQ ID NO: 1870) |
| MGC3-7 | II | nnRnYAY Sequence Number: A363 | APOBEC1 (BE3) SEQ ID NO: 58 | SGSETPGTSESAT PESA (SEQ ID NO: 591) | nMG3-7 (D12A) SEQ ID NO: 73 | UGI (BE3) SEQ ID NO: 67 | GSGGS (SEQ ID NO: 1870) |
| MGC4-5 | II | nRCCV Sequence Number: A365 | APOBEC1 (BE3) SEQ ID NO: 58 | SGSETPGTSESAT PESA (SEQ ID NO: 591) | nMG4-5 (D17A) SEQ ID NO: 74 | UGI (BE3) SEQ ID NO: 67 | GSGGS (SEQ ID NO: 1870) |
| MGC14-1 | II | nRnnGRKA Sequence Number: A366 | APOBEC1 (BE3) SEQ ID NO: 58 | SGSETPGTSESAT PESA (SEQ ID NO: 591) | nMG14-1 (D23A) SEQ ID NO: 76 | UGI (BE3) SEQ ID NO: 67 | GSGGS (SEQ ID NO: 1870) |
| MGC15-1 | II | nnnnC Sequence Number: A367 | APOBEC1 (BE3) SEQ ID NO: 58 | SGSETPGTSESAT PESA (SEQ ID NO: 591) | nMG15-1 (D8A) SEQ ID NO: 77 | UGI (BE3) SEQ ID NO: 67 | GSGGS (SEQ ID NO: 1870) |
| MGC18-1 | II | nRWART Sequence Number: A368 | APOBEC1 (BE3) SEQ ID NO: 58 | SGSETPGTSESAT PESA (SEQ ID NO: 591) | nMG18-1 (D12A) SEQ ID NO: 78 | UGI (BE3) | GSGGS (SEQ ID NO: 1870) |

Example 5—Protein Nucleofection and Amplicon Seq in Mammalian Cells (Prophetic)

Nucleofection is conducted in mammalian cells (e.g. K-562, Neuro-2A or RAW264.7) according to the manufacturer's recommendations using a Lonza 4D Nucleofector® and the Lonza SF Cell Line 4D-Nucleofector® X Kit S (cat. no. V4XC-2032). After formulating the SF nucleofection buffer, 200,000 cells are resuspended in 5 μl of buffer per nucleofection. In the remaining 15 μl of buffer per nucleofection, 20 pmol of chemically modified sgRNA from Synthego is combined with 18 pmol of base editor enzymes (e.g. ABE8e) and incubated for 5 min at room temperature to complex. Cells are added to the 20 μl nucleofection cuvettes, followed by protein solution, and the mixture is triturated to mix. Cells are nucleofected with program CM-130, immediately after which 80 μl of warmed media is added to each well for recovery. After 5 min, 25 μl from each sample is added to 250 μl of fresh media in a 48-well poly-d-lysine plate (Corning). Cells are then treated in the same way as lipofected cells above for genomic DNA extraction after three more days of culture.

Following Illumina barcoding, PCR products are pooled and purified by electrophoresis with a 2% agarose gel using a Monarch® DNA Gel Extraction Kit (New England Biolabs), eluting with 30 μl H2O. DNA concentration is quantified with a Qubit™ dsDNA High Sensitivity Assay Kit (Thermo Fisher Scientific) and sequenced on an Illumina MiSeq instrument (paired-end read, RI: 250-280 cycles, R2: 0 cycles) according to the manufacturer's protocols.

Sequencing reads are demultiplexed using the MiSeq Reporter (Illumina) and FASTQ files are analyzed using CRISPResso2. Dual editing in individual alleles is analyzed by a Python script. Base editing values are representative of n=3 independent biological replicates collected by different researchers, with the mean±s.d. shown. Base editing values are reported as a percentage of the number of reads with adenine mutagenesis over the total aligned reads.

Example 6—Plasmid Nucleofection and Whole Genome Seq in Mammalian Cells (Prophetic)

All plasmids are assembled by the uracil-specific excision reagent (USER) cloning method. Guide RNA plasmids for SpCas9, SaCas9 and all engineered variants are assembled. Plasmids for mammalian cell transfections are prepared using the ZymoPURE Plasmid Midiprep kit (Zymo Research Corporation). HEK293T cells (ATCC CRL-3216)

are cultured in Dulbecco's modified Eagle's medium (Corning) supplemented with 10% fetal bovine serum (ThermoFisher Scientific) and maintained at 37° C. with 5% $CO_2$.

HEK293T cells are seeded on 48-well poly-d-lysine plates (Corning) in the same culture medium. Cells are transfected 12-16 h after plating with 1.5 μl Lipofectamine™ 2000 (ThermoFisher Scientific) using 750 ng base editor plasmid, 250 ng guide RNA plasmid and 10 ng green fluorescent protein as a transfection control. Cells are cultured for 3 d with media exchanged following the first day, then washed with A-1 PBS (ThermoFisher Scientific), followed by genomic DNA extraction by addition of 100 μl freshly prepared lysis buffer (10 mM Tris-HCl, pH 7.5, 0.05% SDS, 25 μg ml-1 proteinase K (ThermoFisher Scientific)) directly into each transfected well. The mixture is incubated at 37° C. for 1 h then heat inactivated at 80° C. for 30 min. Genomic DNA lysate is subsequently used immediately for high-throughput sequencing (HTS).

HTS of genomic DNA from HEK293T cells is performed. Following Illumina barcoding, PCR products are pooled and purified by electrophoresis with a 2% agarose gel using a Monarch® DNA Gel Extraction Kit (NEB), eluting with 30 μl $H_2O$. DNA concentration is quantified with Qubit™ dsDNA High Sensitivity Assay Kit (ThermoFisher Scientific) and sequenced on an Illumina MiSeq instrument (paired end read, R1: 250-280 cycles, R2: 0 cycles) according to the manufacturer's protocols.

Example 7—Determining Editing Window (Prophetic)

To examine the editing window regions, the cytosine showing the highest C-T conversion frequency in a specified sgRNA is normalized to 1, and other cytosines at positions spanning from 30 nt upstream to 10 nt downstream of the PAM sequence (total 43 bp) of the same sgRNA are normalized subsequently. Then normalized C-T conversion frequencies are classified and compared according to their positions for all tested sgRNAs of a specified base editor. A comprehensive editing window (CEW) is defined to span positions with an average C-T conversion efficiency exceeding 0.6 after normalization.

To examine the substrate preference for each cytidine deaminase, C sites are initially classified according to their positions in sgRNA targeting regions and those positions containing at least one C site with >0.8 normalized C-T conversion frequency are included in subsequent analysis. Selected C sites are then compared depending on base types upstream or downstream of the edited cytosine (NC or CN). For cytidine deaminases showing efficient C-T conversion at both N-terminus and C-terminus of the endonuclease, the substrate preference is evaluated by integrating respective NT- and CT-CBEs together. For statistical analysis, one-way ANOVA is used and $p<0.05$ is considered as significant

Example 8a—Testing Off-Target Analysis with Whole Genome Sequencing and Transcriptomics in Mammalian Cells (Prophetic)

HEK293T cells are plated on 48-well poly-d-lysine-coated plates 16 to 20 h before lipofection at a density of 3.104 cells per well in DMEM+GlutaMAX™ medium (Thermo Fisher Scientific) without antibiotics. 750 ng nickase or base editor expression plasmid DNA is combined with 250 ng of sgRNA expression plasmid DNA in 15 μl Opti-MEM™+GlutaMAX™. This is combined with 10 μl of lipid mixture, comprising 1.5 μl Lipofectamine™ 2000 and 8.5 μl Opti-MEM™+GlutaMAX™ per well. Cells are harvested 3 d after transfection and either DNA or RNA was harvested. For DNA analysis, cells are washed once in PBS, and then lysed in 100 μl QuickExtract Buffer (Lucigen) according to the manufacturer's instructions. For RNA harvest, the MagMAX mirVana Total RNA Isolation Kit (Thermo Fisher Scientific) is used with the KingFisher Flex.

Genomic DNA from mammalian cells is fragmented and adapter-ligated using the Nextera DNA Flex Library Prep Kit (Illumina) using 96-well plate Nextera indexing primers (Illumina), according to the manufacturer's instructions. Library size and concentration is confirmed by Fragment Analyzer (Agilent) and DNA is sent to Novogene for WGS using an Illumina HiSeq system.

All targeted NGS data is analyzed by performing four general operations: (1) alignment; (2) duplicate marking; (3) variant calling; and (4) background filtration of variants to remove artifacts and germline mutations. The mutation reference and alternate alleles are reported relative to the plus strand of the reference genome.

For whole Transcriptome sequencing, mRNA selection is performed using the NEBNext Poly(A) mRNA Magnetic Isolation Module (New England BioLabs). RNA library preparation is performed using NEBNext Ultra II RNA Library Prep Kit for Illumina (New England BioLabs). Based on the RNA input amount, a cycle number of 12 is used for the PCR enrichment of adapter-ligated DNA. NEBNext Sample Purification Beads (New England BioLabs) is used throughout for all of the size selection performed by this method. NEBNext Multiplex Oligos for Illumina (New England BioLabs) is used for the multiplex indexes in accordance with the PCR recipe outlined in the protocol. Before sequencing, samples are quality checked using the High Sensitivity D1000 ScreenTape on the 4200 TapeStation System (Agilent). The libraries are pooled and sequenced using a NovaSeq (Novogene). Targeted RNA sequencing is then performed. Complementary DNA is generated by PCR with reverse transcription (RT-PCR) from the isolated RNA using the SuperScript IV One-Step RT-PCR System with EZDnase (Thermo Fisher Scientific) according to the manufacturer's instructions.

The following program is used: 58° C. for 12 min; 98° C. for 2 min; followed by PCR cycles that varied by amplicon: for CTNNB1 and IP90; 32 cycles of (98° C. for 10 s; 60° C. for 10 sec; 72° C. for 30 sec). Following the combined RT-PCR, amplicons are barcoded and sequenced using an Illumina MiSeq sequencer as described above. The first 125 nucleotides in each amplicon, beginning at the first base after the end of the forward primer in each amplicon, are aligned to a reference sequence and used for analysis of maximum A-to-I frequencies in each amplicon. Off-target DNA sequencing is performed using primers, using a two-stage PCR and barcoding method to prepare samples for sequencing using Illumina MiSeq sequencers as above.

Example 8b—Analysis of Off-Target Edits by Whole Genome Sequencing and Transcriptomics (Prophetic)

Transfected cells prepared as in Example 8a are harvested after 3 days and the genomic DNA isolated using the Agencourt DNAdvance Genomic DNA Isolation Kit (Beckman Coulter) according to the manufacturer's instructions. On-target and off-target genomic regions of interest are amplified by PCR with flanking HTS primer pairs. PCR amplification is carried out with Phusion high-fidelity DNA polymerase (ThermoFisher) according to the manufacturer's instructions using 5 ng of genomic DNA as a template. Cycle numbers are determined separately for each primer pair as to ensure the reaction was stopped in the linear range of amplification (30, 28, 28, 28, 32, and 32 cycles for EMX1, FANCF, HEK293 site 2, HEK293 site 3, HEK293 site 4, and RNF2 primers, respectively). PCR products are purified using RapidTips (Diffinity Genomics). Purified DNA is amplified by PCR with primers containing sequencing adaptors. The products are gel-purified and quantified using the Quant-iT™ PicoGreen dsDNA Assay Kit (ThermoFisher) and KAPA Library Quantification Kit-Illumina (KAPA Biosystems). Samples are sequenced on an Illumina MiSeq as previously described.

Sequencing reads are automatically demultiplexed using MiSeq Reporter (Illumina), and individual FASTQ files are analyzed with a custom Matlab script. Each read is pairwise aligned to the appropriate reference sequence using the Smith-Waterman algorithm. Base calls with a Q-score below 31 are replaced with N's and are thus excluded in calculating nucleotide frequencies. This treatment yields an expected MiSeq base-calling error rate of approximately 1 in 1,000. Aligned sequences in which the read and reference sequence contained no gaps are stored in an alignment table from which base frequencies were tabulated for each locus. Indel frequencies were quantified with a custom Matlab script.

Sequencing reads are scanned for exact matches to two 10-bp sequences that flank both sides of a window in which indels might occur. If no exact matches were located, the read is excluded from analysis. If the length of this indel window exactly matched the reference sequence the read is classified as not containing an indel. If the indel window is two or more bases longer or shorter than the reference sequence, then the sequencing read is classified as an insertion or deletion, respectively.

Example 9—Mouse Editing Experiments (Prophetic)

It is envisaged that a base editor comprising a novel DNA targeting nuclease domain fused to a novel deaminase domain can be validated as a therapeutic candidate by testing in appropriate mouse models of disease.

One example of an appropriate model comprises mice that have been engineered to express the human PCSK9 protein, for example, as described by Herbert et al (10.1161/ATVBAHA.110.204040). The PCSK9 protein regulates LDL receptor (LDLR) levels and influences serum cholesterol levels. Mice expressing the human PCSK9 protein exhibit elevated levels of cholesterol and more rapid development of atherosclerosis. PCSK9 is a validated drug target for the reduction of lipid levels in people at increased risk of cardiovascular disease due abnormally high plasma lipid levels (doi.org/10.1038/s41569-018-0107-8). Reducing the levels of PCSK9 via genome editing is expected to permanently lower lipid levels for the life-time of the individual thus providing a life-long reduction in cardiovascular disease risk. One genome editing approach can involve targeting the coding sequence of the PCSK9 gene with the goal of editing a sequence to create a premature stop codon and thus prevent the translation of the PCSK9 mRNA into a functional protein. Targeting a region close to the 5' end of the coding sequence is useful in order to block translation of the majority of the protein. To create a stop codon (TGA, TAA, TAG) with high efficiency and specificity will require targeting a region of the PCSK9 coding sequence wherein the editing window will be placed over an appropriate sequence such that the highest frequency editing event results in a stop codon. Therefore, the availability of multiple base editing systems with a wide range of PAMs or a base editing system with a degenerate PAM is useful to access a larger number of potential target sites in the PCSK9 gene. In addition, additional editing systems wherein the frequency of off-target editing is low (e.g. in the range of 1% or less of the on-target editing events) are also useful to perform gene editing in this context.

The efficiency of base editing required for a therapeutic effect is in the range of 50% or higher in order to achieve a significant reduction in plasma lipid levels. An example of the use of a base editor to create a stop codon in the PCSK9 gene is that of Carreras et al (doi.org/10.1186/s12915-018-0624-2) in which between 10% and 34% of the PCSK9 alleles were edited to create a stop codon. While this level of editing was sufficient to result in a measurable reduction in plasma lipid levels in the mice, a higher editing efficiency will be required for therapeutic use in humans.

To identify a base-editing (BE) system and a guide that are optimal for introducing the stop codons in the PCSK9 gene, a screen may be performed in a mouse liver cell line such as Hepa1-6 cells. In silico screening may first be used to identify guides that target the PCSK9 gene with the various BE systems available. To select among the large number of possible guides an in-silico analysis may be performed to determine which guides have an editing window that encompasses a sequence that when edited may create a stop codon. Preference may then be given to those guides that are closer to the 5' end of the coding sequence. The resulting set of guides and BE proteins may be combined to form a ribonucleoprotein complex (RNP) and may be nucleofected into Hepa1-6 cells. After 72 h the efficiency of editing at the target site may be determined by NGS analysis. Based on these in vitro results the one or more BE/guide combinations that resulted in the highest frequency of stop codon formation may be selected for in vivo testing.

For application in a human therapeutic setting a safe and effective method of delivering the base editing components comprising the base editor and the guide RNA is required. In vivo delivery methods can be divided in to viral or non-viral methods. Among viral vectors the Adeno Associated Virus (AAV) is the virus of choice for clinical use due to its safety record, efficient delivery to multiple tissues and cell types and established manufacturing processes. The large size of base editors (BE) exceeds the packaging capacity of AAV which interferes with packaging in a single Adeno Associated Virus. While approaches that package BE into two AAV using split intein technology have been demonstrated to be successful in mice (doi.org/10.1038/s41551-019-0501-5), the requirement for 2 viruses can complicate development and manufacture. An additional disadvantage of AAV is that while the virus does not have a mechanism for promoting integration into the genome of host cells, and most of the AAV genomes remain episomal, a fraction of the AAV genomes do become integrated at random double strand breaks that occur naturally in cells (Curr Opin Mol Ther. 2009 August; 11(4): 442-447). This may lead to the persistence of gene sequences expressing the BE for the life-time of the organism. Moreover, AAV genomes persist as episomes inside the nucleus of transduced cells and can be maintained for years which may result in the long-term expression of BE in these cells and thus an increased risk of off-target effects because the risk of an off-target event occurring is a function of the time over which the editing enzyme is active. Adenovirus (Ad) such as Ad5 can efficiently deliver DNA payloads to the liver of mammals and can package up to 45 kb of DNA. However, adenoviruses are understood to induce a strong immune response in mammals (dx.doi.org/10.1136/gut.48.5.733), including in patients which can result in serious adverse events including death (doi.org/10.1016/j.ymthe.2020.02.010).

Non-viral delivery vectors (reviewed in doi:10.1038/mt.2012.79) which include lipid nanoparticles and polymeric nanoparticles have several advantages compared to viral delivery vectors including lower immunogenicity and transient expression of the nucleic acid cargo. The transient expression elicited by non-viral delivery vectors is particularly suited to genome editing applications because it is expected to minimize off target events. In addition, non-viral delivery unlike viral vectors has the potential for repeat administration to achieve the therapeutic effect. There is also no theoretical limit to the size of the nucleic acid molecules that can be packaged in non-viral vectors, although in practice the packaging becomes less efficient as the size of the nucleic acid increases and the particles size may increase.

A BE may be delivered in vivo using a non-viral vector such as a lipid nanoparticle (LNP) by encapsulating a synthetic mRNA encoding the BE together with the guide RNA into the LNP. This can be performed using any suitable methodology, for example as described by Finn et al (DOI: 10.1016/j.celrep.2018.02.014) or Yin et al (doi:10.1038/nbt.3471). LNP can deliver their cargo with a bias to the hepatocytes of the liver, which is also a target organ/cell type when attempting to interfere with the expression of the PCSK9 gene. In order to demonstrate proof of concept for this approach we envisage that a BE comprised of a novel genome editing protein fused to a deaminase domain may be encoded in a synthetic mRNA and packaged in a LNP together with an appropriate guide RNA that targets the selected site in the PCSK9 gene of the mouse. In the case of mice that were engineered to express the human PCSK9 gene the guide may be designed to target selectively the human PCSK9 gene or both the human and mouse PCSK9 genes. Following injection of these LNP the editing efficiency at the on-target site in the genome of the liver cells may be analyzed by amplicon sequencing or other methods such as tracking of indels by decomposition (doi: 10.1093/nar/gku936). The physiologic impact may be determined by measuring lipid levels in the blood of the mice, including total cholesterol and triglyceride levels using standard methods.

Another example of a disease that may be modeled in mice to evaluate a novel BE is Primary Hyperoxaluria type I. Primary Hyperoxaluria type I (PH1) is a rare autosomal recessive disease caused by defects in the AGXT gene that encodes the enzyme alanine-glyoxylate aminotransferase. This results in a defect in glyoxylate metabolism and the accumulation of the toxic metabolite oxalate. One approach to treating this disease is to reduce the expression of the enzyme glycolate oxidase (GO) that produces glyoxylate from glycolate and thereby reducing the amount of substrate (glyoxylate) available for the formation of oxalate. PH1 can be modeled in mice in which both copies of the AGXT gene have been knocked out (agxt −/− mice) resulting in a significant 3-fold increase in oxalate levels in the urine compared to wild type controls. The agxt −/− mice can therefore be used to assess the efficacy of a novel base editor designed to create a stop codon in the coding sequence of the endogenous mouse GO gene. To identify a BE system and a guide that is optimal for introducing stop codons in the GO gene, a screen may be performed in a mouse liver cell line such as Hepa1-6 cells. In silico screening may first be used to identify guides that target the GO gene with the various BE systems available. To select among the large number of possible guides an in-silico analysis may be performed to determine which guides have an editing window that encompasses a sequence that when edited may create a stop codon. In some instances, guides closer to the 5' end of the coding sequence may be utilized. The resulting set of guides and BE proteins may be combined to form a ribonucleoprotein complex (RNP) and may be nucleofected in to Hepa1-6 cells. After 72 h, the efficiency of editing at the target site may be determined by NGS analysis. Based on these in vitro results the one or more BE/guide combinations that resulted in the highest frequency of stop codon formation may be selected for in vivo testing in mice.

The BE and guide may be delivered to the mice using an AAV virus with a split intein system to express the BE and a 3rd AAV to deliver the guide. Alternatively, an Adenovirus type 5 may be used to deliver the BE and guide in a single virus because of the >40 Kb packaging capacity of Adenovirus. Further, the BE may be delivered as a mRNA together with the guide RNA packaged in an appropriate LNP. After intravenous injection of the LNP into the agxt −/− mice the oxalate levels in the urine may be monitored over time to determine if oxalate levels were reduced which may indicate that the BE was active and had the expected therapeutic effect. To determine if the BE had introduced the stop codons, the appropriate region of the GO gene can be PCR amplified from the genomic DNA extracted from livers of treated and control mice. The resultant PCR product can be sequenced using Next Generation Sequencing to determine the frequency of the sequence changes.

Example 10—Gene Discovery of New Deaminases

4 Tbp (tera base pairs) of proprietary and public assembled metagenomic sequencing data from diverse environments (soil, sediments, groundwater, thermophilic, human, and non-human microbiomes) were mined to discover novel deaminases. HMM profiles of documented deaminases were built and searched against all predicted proteins using HMMER3 (hmmer.org) to identify deaminases from our databases. Predicted and reference (e.g., eukaryotic APOBEC1, bacterial TadA) deaminases were aligned with MAFFT and a phylogenetic tree was inferred using FastTree2. Novel families and subfamilies were defined by identifying clades composed of sequences disclosed herein. Candidates were selected based on the presence of critical catalytic residues indicative of enzymatic function (see e.g. SEQ ID NOs: 1-51, 385-386, 387-443, 444-447, 488-475, 599-675, 744-835, or 970-982).

Example 11—Plasmid Construction

DNA fragments of genes were synthesized at either Twist Bioscience or Integrated DNA Technologies (IDT). Plasmid DNA was amplified in Endura electrocompetent cells (Lucigen) and isolated by QIAprep Spin Miniprep Kit (Qiagen). Vector backbones were prepared by restriction enzyme digestion of plasmids. Inserts were amplified by Q5® High-Fidelity DNA polymerase (New England Biolabs) using primers (SEQ ID NOs: 690-707) ordered either from Elim BIOPHARM or IDT. Both vector backbones and inserts were purified by gel extraction using the Gel DNA Recovery Kit (Zymo Research). One or multiple DNA fragments were assembled into the vectors through NEBuilder® HiFi DNA assembly (New England Biolabs) (SEQ ID NOs.483-487, 720-726, or 737-738).

Example 12—Assessment of Base Edit Efficiency in *E. coli* by Sequencing 5 ng extracted DNA prepared as in Example 4 was used as the template and primers (P137 and P360) were used for PCR amplification, and the resulting products were submitted for Sanger sequencing at ELIM BIOPHARM. Primers used for sequencing are shown in Tables 6 and 7 (Seq ID NOs. 523-531).

TABLE 6

Primers used for base editing analysis of lacZ gene in *E. coli*

| Name | SEQ ID NO. | Description | Sequence (5'→3') |
|---|---|---|---|
| P137 | 523 | Forward primer used to amplify lacZ | CCAGGCTTTACACTTTATGCT |
| P360 | 524 | Reverse primer used to amplify lacZ | CGAACATCCAAAAGTTTGTGTTTTT |
| P137 | 523 | Sanger sequencing primer of MGA1-4_site 1 | CCAGGCTTTACACTTTATGCT |
| P137 | 523 | Sanger sequencing primer of MGA1-4_site 2 | CCAGGCTTTACACTTTATGCT |
| P361 | 528 | Sanger sequencing primer of MGA1-4_site 3 | TGAGCGCATTTTTACGCGC |
| P361 | 528 | Sanger sequencing primer of MGA1-6_site 1 | TGAGCGCATTTTTACGCGC |
| P361 | 528 | Sanger sequencing primer of MGA1-6_site 2 | TGAGCGCATTTTTACGCGC |
| P361 | 528 | Sanger sequencing primer of MGA1-6_site 3 | TGAGCGCATTTTTACGCGC |
| P361 | 528 | Sanger sequencing primer of MGA3-6_site 1 | TGAGCGCATTTTTACGCGC |
| P363 | 529 | Sanger sequencing primer of MGA3-6_site 2 | GAAAACGGCAACCCGTGG |
| P360 | 524 | Sanger sequencing primer of MGA3-6_site 3 | CGAACATCCAAAAGTTTGTGTTTTT |
| P137 | 523 | Sanger sequencing primer of MGA3-7_site 1 | CCAGGCTTTACACTTTATGCT |
| P361 | 528 | Sanger sequencing primer of MGA3-7_site 2 | TGAGCGCATTTTTACGCGC |
| P361 | 528 | Sanger sequencing primer of MGA3-7_site 3 | TGAGCGCATTTTTACGCGC |
| P137 | 523 | Sanger sequencing primer of MGA3-8_site 1 | CCAGGCTTTACACTTTATGCT |
| P361 | 528 | Sanger sequencing primer of MGA3-8_site 2 | TGAGCGCATTTTTACGCGC |
| P363 | 529 | Sanger sequencing primer of MGA3-8_site 3 | GAAAACGGCAACCCGTGG |
| P139 | 526 | Sanger sequencing primer of MGA4-2_site 1 | GTATGTGGTGGATGAAGCC |
| P363 | 529 | Sanger sequencing primer of MGA4-2_site 2 | GAAAACGGCAACCCGTGG |
| P360 | 524 | Sanger sequencing primer of MGA4-2_site 3 | CGAACATCCAAAAGTTTGTGTTTTT |
| P361 | 528 | Sanger sequencing primer of MGA4-5 Site 1 | TGAGCGCATTTTTACGCGC |
| P361 | 528 | Sanger sequencing primer of MGA4-5 Site 2 | TGAGCGCATTTTTACGCGC |
| P461 | 530 | Sanger sequencing primer of MGA4-5_Site 3 | GGATTGAAAATGGTCTGCTG |
| P137 | 523 | Sanger sequencing primer of MGA7-1_site 1 | CCAGGCTTTACACTTTATGCT |
| P361 | 528 | Sanger sequencing primer of MGA7-1_site 2 | TGAGCGCATTTTTACGCGC |

TABLE 6-continued

Primers used for base editing analysis of lacZ gene in *E. coli*

| Name | SEQ ID NO. | Description | Sequence (5'→3') |
|---|---|---|---|
| P461 | 530 | Sanger sequencing primer of MGA7-1_site 3 | GGATTGAAAATGGTCTGCTG |
| P139 | 526 | Sanger sequencing primer of MGA14-1_site 1 | GTATGTGGTGGATGAAGCC |
| P363 | 529 | Sanger sequencing primer of MGA14-1_site 2 | GAAAACGGCAACCCGTGG |
| P360 | 524 | Sanger sequencing primer of MGA14-1_site 3 | CGAACATCCAAAAGTTTGTGTTTTT |
| P137 | 523 | Sanger sequencing primer of MGA15-1_site 1 | CCAGGCTTTACACTTTATGCT |
| P361 | 528 | Sanger sequencing primer of MGA15-1_site 2 | TGAGCGCATTTTTACGCGC |
| P140 | 527 | Sanger sequencing primer of MGA15-1_site 3 | TTGTGGAGCGACATCCAG |
| P137 | 523 | Sanger sequencing primer of MGA16-1_site 1 | CCAGGCTTTACACTTTATGCT |
| P361 | 528 | Sanger sequencing primer of MGA16-1_site 2 | TGAGCGCATTTTTACGCGC |
| P361 | 528 | Sanger sequencing primer of MGA16-1_site 3 | TGAGCGCATTTTTACGCGC |
| P361 | 528 | Sanger sequencing primer of MGA18-1_site 1 | TGAGCGCATTTTTACGCGC |
| P363 | 529 | Sanger sequencing primer of MGA18-1_site 2 | GAAAACGGCAACCCGTGG |
| P462 | 531 | Sanger sequencing primer of MGA18-1_site 3 | ACTGCTGACGCCGCTGCG |
| P363 | 529 | Sanger sequencing primer of ABE8.17_site 1 | GAAAACGGCAACCCGTGG |
| P137 | 523 | Sanger sequencing primer of ABE8.17_site 2 | CCAGGCTTTACACTTTATGCT |
| P139 | 526 | Sanger sequencing primer of ABE8.17_site 3 | GTATGTGGTGGATGAAGCC |
| P137 | 523 | Sanger sequencing primer of MGC1-4_site 1 | CCAGGCTTTACACTTTATGCT |
| P137 | 523 | Sanger sequencing primer of MGC1-4_site 2 | CCAGGCTTTACACTTTATGCT |
| P361 | 528 | Sanger sequencing primer of MGC1-4_site 3 | TGAGCGCATTTTTACGCGC |
| P137 | 523 | Sanger sequencing primer of MGC1-6_site 1 | CCAGGCTTTACACTTTATGCT |
| P137 | 523 | Sanger sequencing primer of MGC1-6_site 2 | CCAGGCTTTACACTTTATGCT |
| P361 | 528 | Sanger sequencing primer of MGC1-6_site 3 | TGAGCGCATTTTTACGCGC |
| P138 | 525 | Sanger sequencing primer of MGC3-6_site 1 | CCGAAAGGCGCGGTGCCG |
| P361 | 528 | Sanger sequencing primer of MGC3-6_site 2 | TGAGCGCATTTTTACGCGC |
| P360 | 524 | Sanger sequencing primer of MGC3-6_site 3 | CGAACATCCAAAAGTTTGTGTTTTT |

TABLE 6-continued

Primers used for base editing analysis of lacZ gene in *E. coli*

| Name | SEQ ID NO. | Description | Sequence (5'→3') |
|---|---|---|---|
| P137 | 523 | Sanger sequencing primer of MGC3-7_site 1 | CCAGGCTTTACACTTTATGCT |
| P137 | 523 | Sanger sequencing primer of MGC3-7_site 2 | CCAGGCTTTACACTTTATGCT |
| P137 | 523 | Sanger sequencing primer of MGC3-7_site 3 | CCAGGCTTTACACTTTATGCT |
| P137 | 523 | Sanger sequencing primer of MGC3-8_site 1 | CCAGGCTTTACACTTTATGCT |
| P361 | 528 | Sanger sequencing primer of MGC3-8_site 2 | TGAGCGCATTTTTACGCGC |
| P361 | 528 | Sanger sequencing primer of MGC3-8_site 3 | TGAGCGCATTTTTACGCGC |
| P361 | 528 | Sanger sequencing primer of MGC4-2_site 1 | TGAGCGCATTTTTACGCGC |
| P139 | 526 | Sanger sequencing primer of MGC4-2_site 2 | GTATGTGGTGGATGAAGCC |
| P363 | 529 | Sanger sequencing primer of MGC4-2_site 3 | GAAAACGGCAACCCGTGG |
| P137 | 523 | Sanger sequencing primer of MGC4-5_site 1 | CCAGGCTTTACACTTTATGCT |
| P361 | 528 | Sanger sequencing primer of MGC4-5_site 2 | TGAGCGCATTTTTACGCGC |
| P139 | 526 | Sanger sequencing primer of MGC4-5_site 3 | GTATGTGGTGGATGAAGCC |
| P361 | 528 | Sanger sequencing primer of MGC7-1_site 1 | TGAGCGCATTTTTACGCGC |
| P461 | 530 | Sanger sequencing primer of MGC7-1_site 2 | GGATTGAAAATGGTCTGCTG |
| P139 | 526 | Sanger sequencing primer of MGC7-1_site 3 | GTATGTGGTGGATGAAGCC |
| P137 | 523 | Sanger sequencing primer of MGC14-1_site 1 | CCAGGCTTTACACTTTATGCT |
| P139 | 526 | Sanger sequencing primer of MGC14-1_site 2 | GTATGTGGTGGATGAAGCC |
| P139 | 526 | Sanger sequencing primer of MGC14-1_site 3 | GTATGTGGTGGATGAAGCC |
| P361 | 528 | Sanger sequencing primer of MGC15-1_site 1 | TGAGCGCATTTTTACGCGC |
| P461 | 530 | Sanger sequencing primer of MGC15-1_site 2 | GGATTGAAAATGGTCTGCTG |
| P139 | 526 | Sanger sequencing primer of MGC15-1_site 3 | GTATGTGGTGGATGAAGCC |
| P137 | 523 | Sanger sequencing primer of MGC16-1_site 1 | CCAGGCTTTACACTTTATGCT |
| P137 | 523 | Sanger sequencing primer of MGC16-1_site 2 | CCAGGCTTTACACTTTATGCT |
| P361 | 528 | Sanger sequencing primer of MGC16-1_site 3 | TGAGCGCATTTTTACGCGC |
| P361 | 528 | Sanger sequencing primer of MGC18-1_site 1 | TGAGCGCATTTTTACGCGC |

TABLE 6-continued

Primers used for base editing analysis of lacZ gene in *E. coli*

| Name | SEQ ID NO. | Description | Sequence (5'→3') |
|---|---|---|---|
| P139 | 526 | Sanger sequencing primer of MGC18-1_site 2 | GTATGTGGTGGATGAAGCC |
| P363 | 529 | Sanger sequencing primer of MGC18-1_site 3 | GAAAACGGCAACCCGTGG |
| P363 | 529 | Sanger sequencing primer of BE3_site 1 | GAAAACGGCAACCCGTGG |
| P360 | 524 | Sanger sequencing primer of BE3_site 2 | CGAACATCCAAAAGTTTGTGTTTTT |
| P137 | 523 | Sanger sequencing primer of BE3_site 3 | CCAGGCTTTACACTTTATGCT |

TABLE 7

Primers used for base editing analysis of the effect of uracil glycosylase inhibitor (UGI) in *E. coli*

| Name | SEQ ID NO. | Description | Sequence (5'→3') |
|---|---|---|---|
| P137 | 523 | Forward primer used to amplify lacZ | CCAGGCTTTACACTTTATGCT |
| P360 | 524 | Reverse primer used to amplify lacZ | CGAACATCCAAAAGTTTGTGTTTTT |
| P461 | 530 | Sanger sequencing primer of lacZ site | GGATTGAAAATGGTCTGCTG |

Figure 8A:
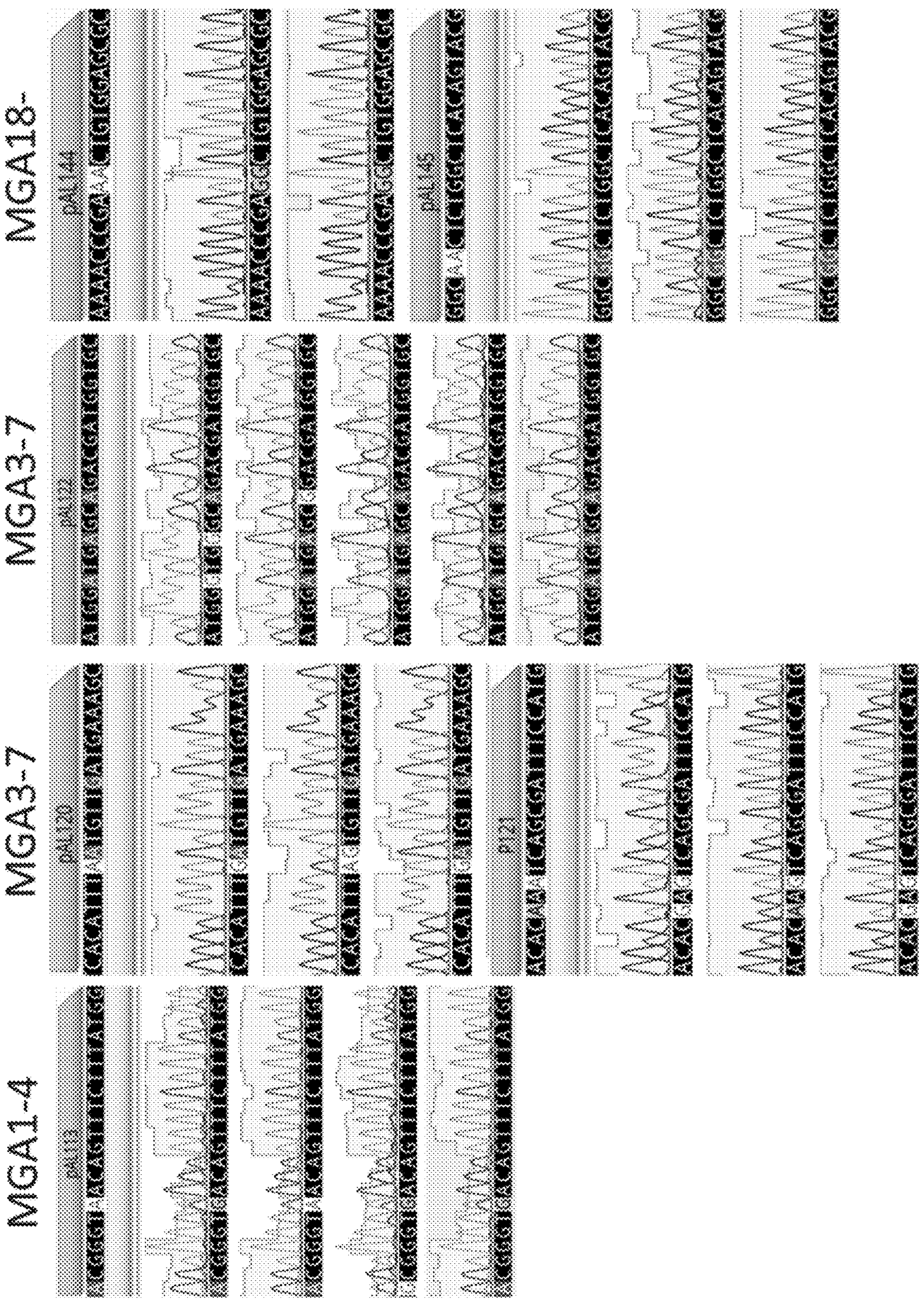
FIGS. 8A (SEQ ID NOs: 99, 1740, 99, 1741, 1740, 106, 1742-1743, 1742, 107, 1744-1745, 1744, 1747, 1746, 1876, 108, 108, 108, 101, 1748, 1748, 122, 1749, 1749 and 1749, in order of columns), 8B (SEQ ID NOs: 132, 1750, 1750, 1750, 136, 1751, 136-137, 1752-1753, 1753, 112, 1754-1755, 1877, 145, 1756, 145, 145, 145 and 145, in order of columns), and 8C (SEQ ID NOs: 149, 1757, 1757-1758, 1758, 129, 1759-1761, 152, 1762-1763, 1763, 153 and 1764-1765 and 1765, in order of columns) shows Sanger sequencing results demonstrating base edits by selected systems described herein.
Figure 8B:
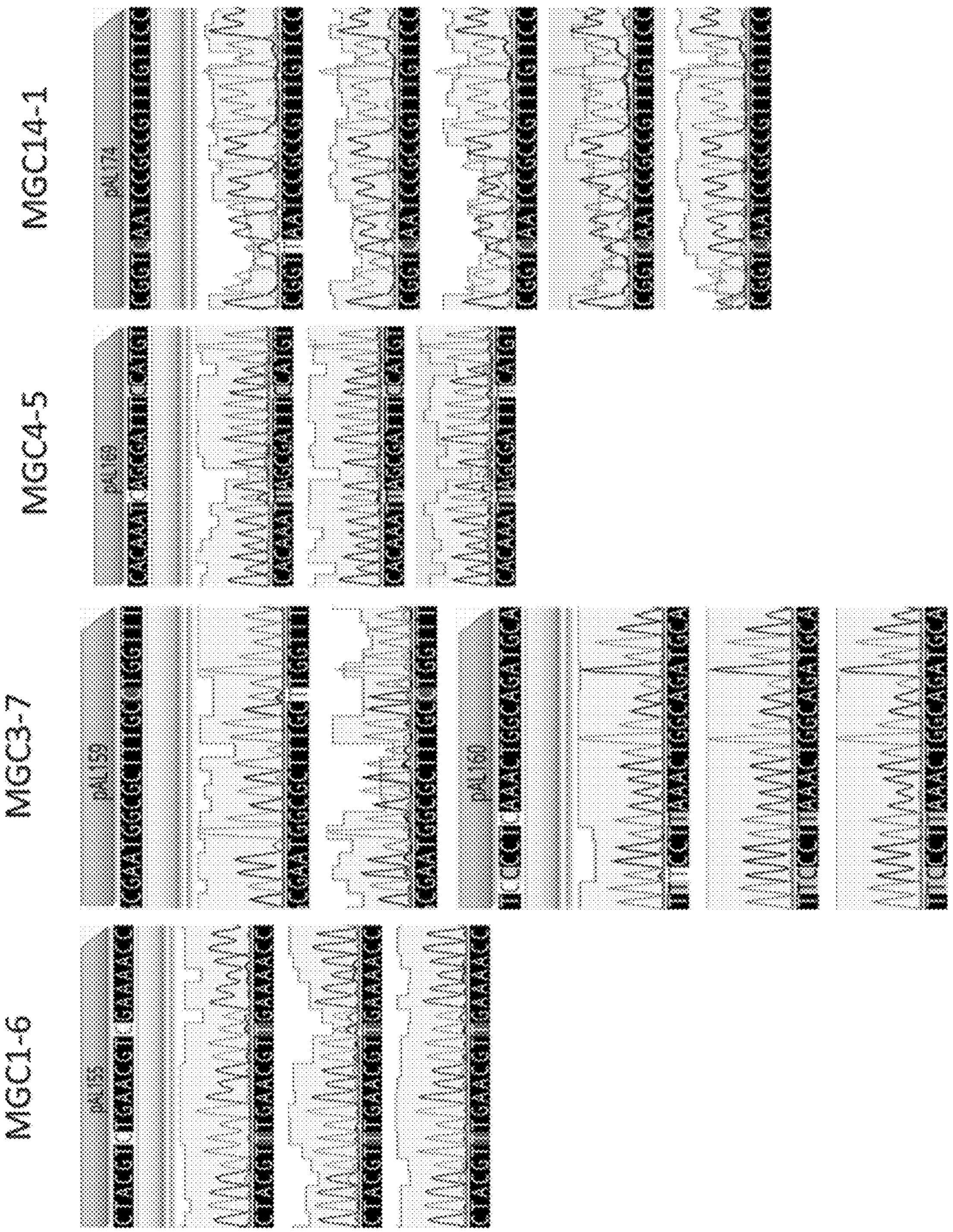
Figure 8C:
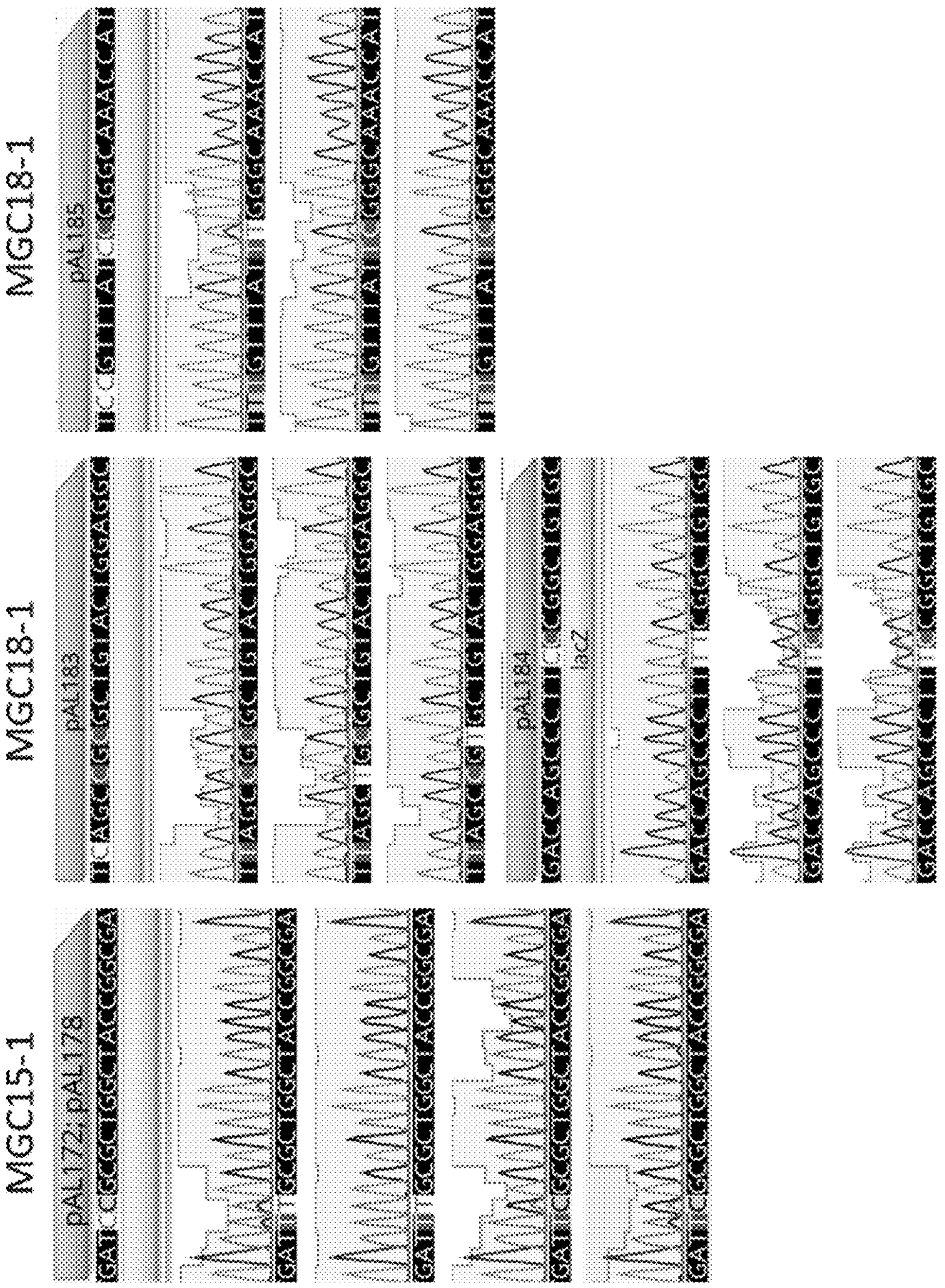
Figure 9:
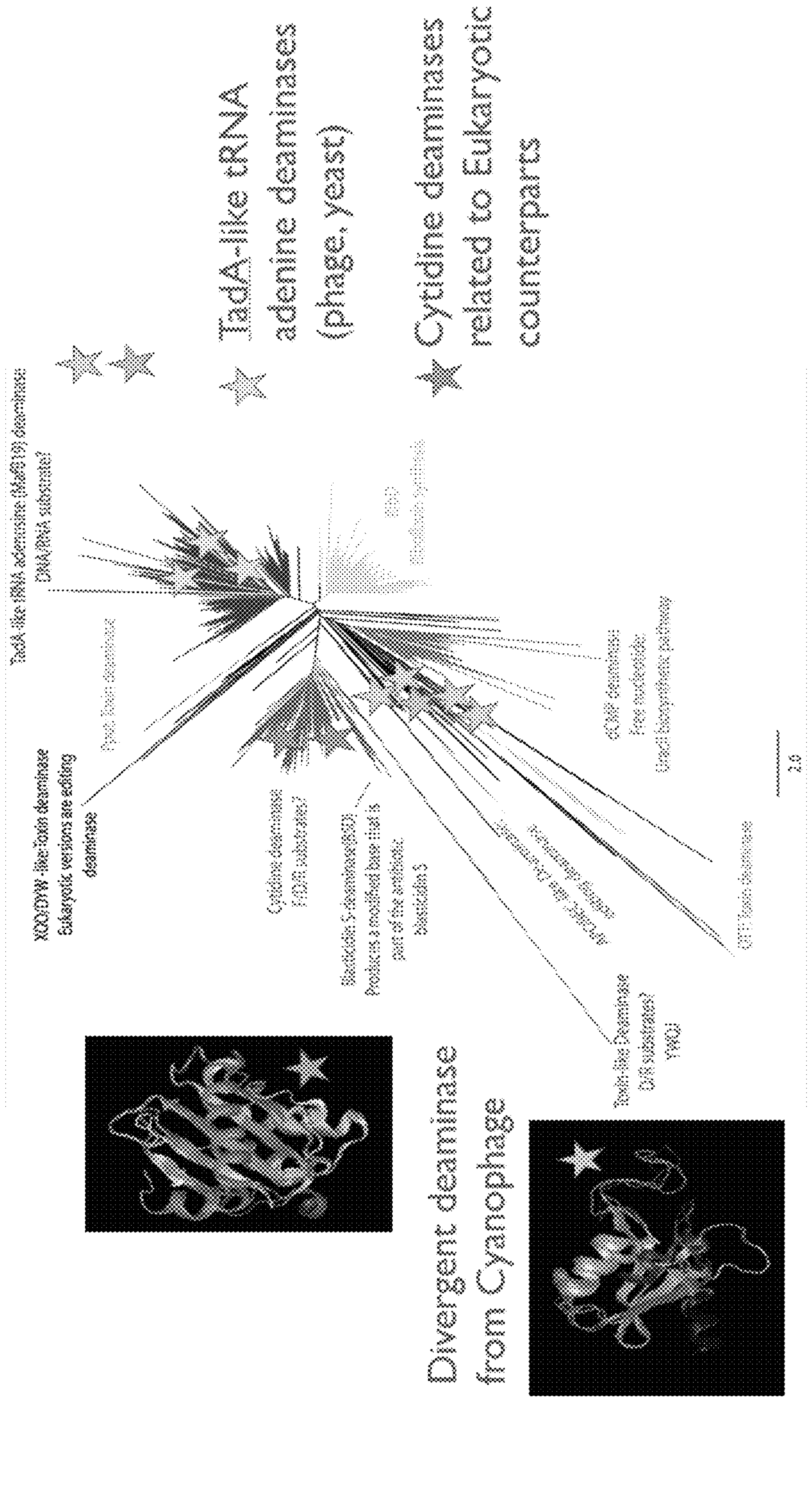
FIG. 9 shows how the systems described herein expand base-editing capabilities with the endonucleases and base editors described herein.

FIGS. 8A-8C shows example base edits by enzymes interrogated by this experiment, as assessed by Sanger sequencing.

Figure 10A:
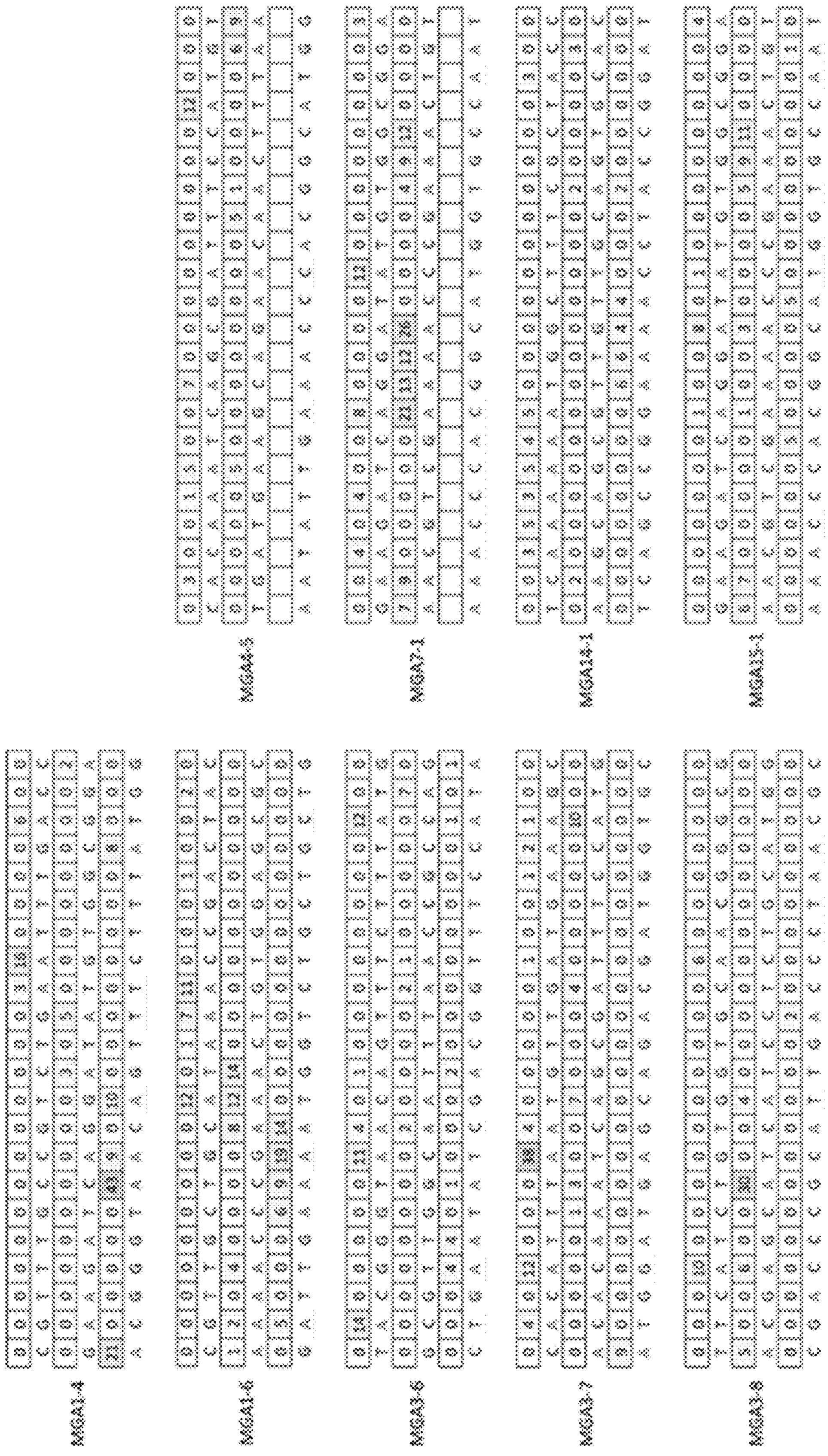
FIGS. 10A (SEQ ID NOs: 97-114, 1686-1688 and 115-120, in order of columns) and 10B (SEQ ID NOs: 1695-1703, in order of columns) show base editing efficiencies of adenine base editors (ABEs) comprising TadA (ABE8.17m) and MG nickases. TadA is a tRNA adenine deaminase, and TadA (ABE8.17m) is an engineered variant of *E. coli* TadA. 12 MG nickases fused with TadA (ABE8.17m) were constructed and tested in *E. coli*. Three guides were designed to target lacZ. Numbers shown in boxes indicate percentages of A to G conversion quantified by Edit R. ABE8.17m was used as the positive control for the experiment.
Figure 10B:
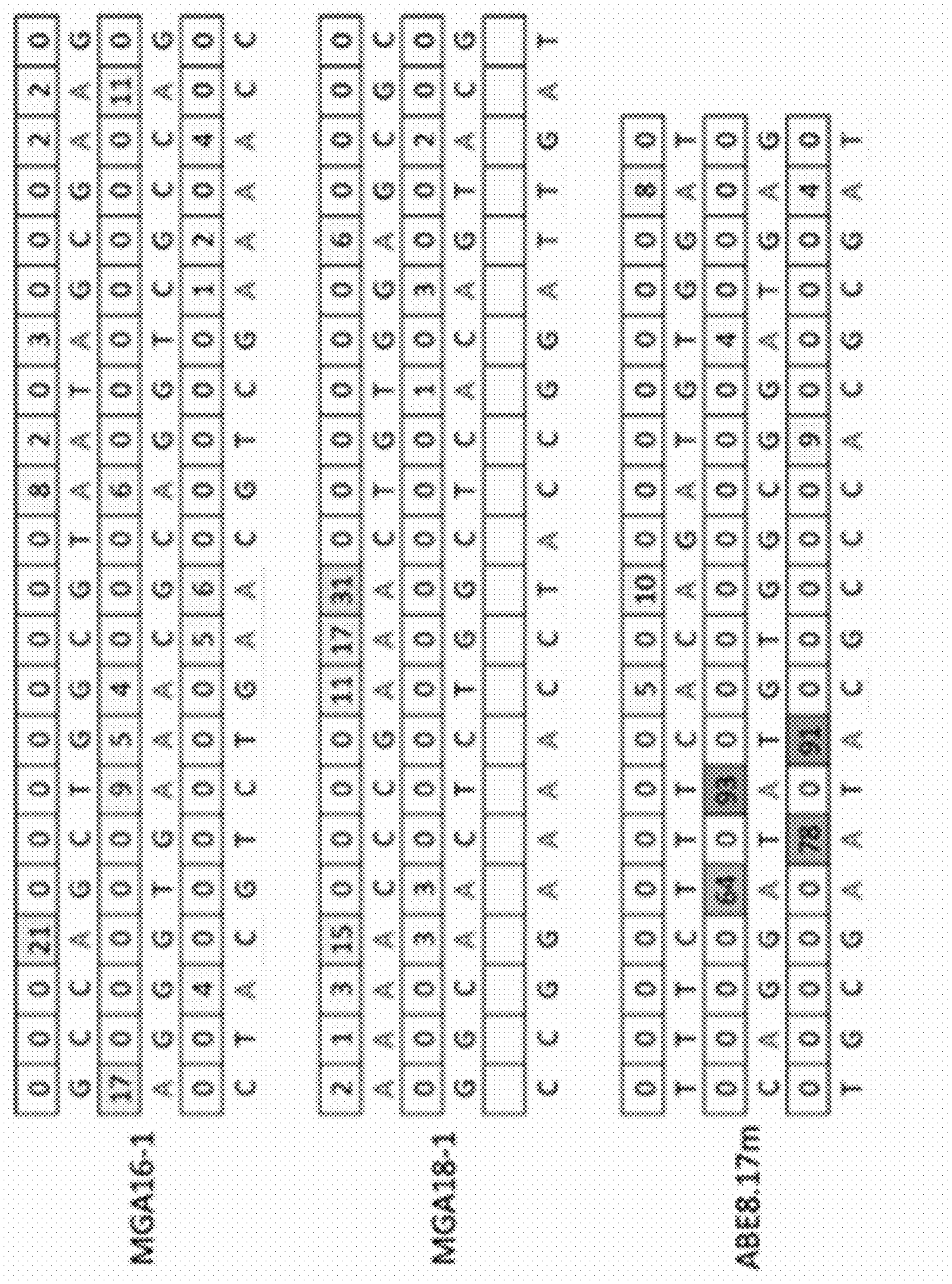

FIGS. 10A-10B shows base editing efficiencies of adenine base editors (ABEs) using TadA (ABE8.17m) (SEQ ID NO: 596) and MG nickases according to Table 3. TadA is a tRNA adenine deaminase; TadA (ABE8.17m) is an engineered variant of *E. coli* TadA. Twelve MG nickases fused with TadA (ABE8.17m) were constructed and tested in *E. coli*. Three guides were designed to target lacZ. Numbers shown in boxes indicate percentages of A to G conversion quantified by Edit R at each position. ABE8.17m was used as the positive control for the experiment.

Figure 11A:
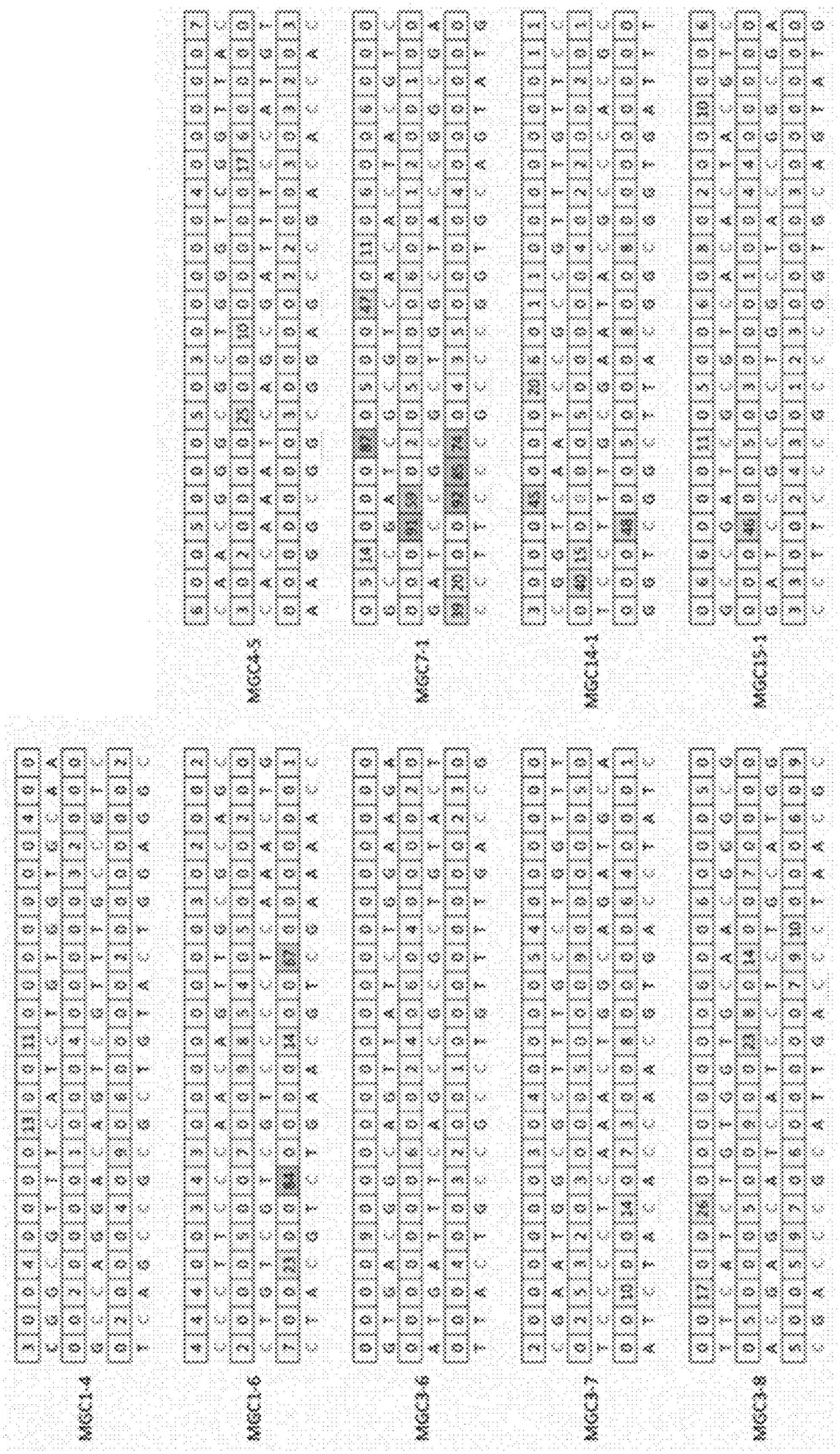
FIGS. 11A (SEQ ID NOs: 127-144, 1722-1724 and 145-150, in order of columns) and 11B (SEQ ID NOs: 1731-1739, in order of columns) show base editing efficiencies of cytosine base editors (CBEs) comprising rat APOBEC1, MG nickases, and the uracil glycosylase inhibitor of *Bacillus subtilis* bacteriophage (UGI (PBS1)). APOBEC1 is a cytidine deaminase. 12 MG nickases fused to rAPOBEC1 on their N-terminus and UGI on their C-terminus were constructed and tested in *E. coli*. Three guides were designed to target lacZ. The numbers shown in boxes indicate percentages of C to T conversion quantified by Edit R. BE3 was used as the positive control in the experiment.
Figure 11B:

FIGS. 11A-11B shows base editing efficiencies of cytosine base editors (CBEs) comprising rat APOBEC1, MG nickases, and uracil glycosylase inhibitor of *Bacillus subtilis* bacteriophage (UGI (PBS1)). APOBEC1 is a cytidine deaminase. 12 MG nickases fused with rAPOBEC1 on N-terminus and UGI on C-terminus were constructed and tested in *E. coli*. Three guides were designed to target lacZ. Numbers shown in boxes indicate percentages of C to T conversion quantified by Edit R. BE3 was used as the positive control in the experiment.

Figure 12B:
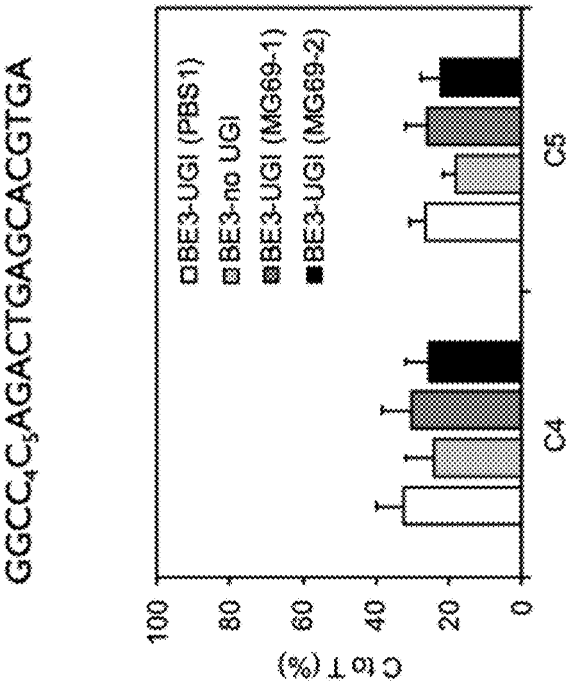
FIG. 12B is a graph showing base editing activity of BE3, which comprises an N-terminal rAPOBEC1, the SpCas9 nickase, and a C-terminal UGI. Two MG UGIs were tested for improvements of cytosine base editing activities in HEK293T cells. Editing efficiencies were quantified by Edit R.
Figure 12A:
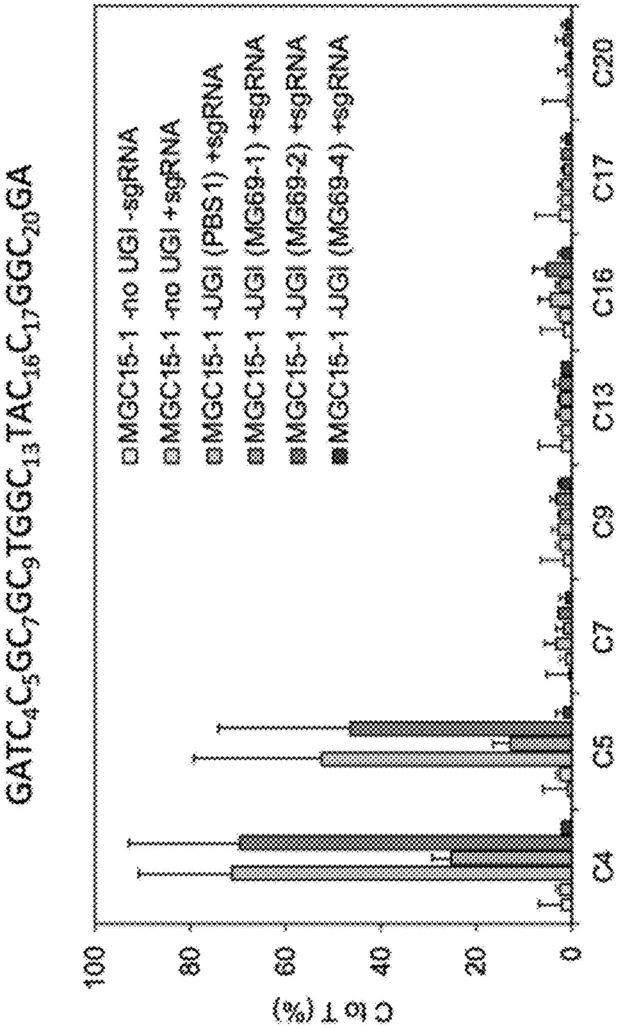
FIG. 12A (SEQ ID NO: 1766) and 12B (SEQ ID NO: 1767) show effects of MG uracil glycosylase inhibitors (UGIs) on the base-editing activities of CBEs.

FIGS. 12A-B show effects of MG uracil glycosylase inhibitors (UGIs) on base editing activity when added to CBEs. FIG. 12A shows MGC15-1 comprises of N-terminal APOBEC1, MG15-1 nickase, and C-terminal UGI. Three MG UGIs were tested for improvements of cytosine base editing activities in *E. coli*. (b) BE3 comprises N-terminal rAPOBEC1, SpCas9 nickase, and C-terminal UGI. Two MG UGIs were tested for improvements of cytosine base editing activities in HEK293T cells. Editing efficiencies were quantified by Edit R.

Example 13—Cell Culture, Transfections, Next Generation Sequencing, and Base Edit Analysis HEK293T cells were grown and passaged in Dulbecco's Modified Eagle's Medium plus GlutaMAX™ (Gibco) supplemented with 10G (v/v) fetal bovine serum (Gibco) at 37° C. with 5% $CO_2$. $5\times10^4$ cells were seeded on 96-well cell culture plates treated for cell attachment (Costar), grown for 20 to 24 h, and the spent media were refreshed with new media right before transfection. 200 ng expression plasmid and 1 G Lipofectamine™ 2000 (ThermoFisher Scientific) were used for transfection per well per manufacturer's instructions. Transfected cells were grown for 3 days, harvested, and gDNA was extracted with QuickExtract (Lucigen) per manufacturer's instructions. Targeted regions for base edits were amplified using Q5® High-Fidelity DNA polymerase (New England Biolabs) with primers listed in Tables 8 and 9 (SEQ ID NOs. 538-585) and extracted DNA as the templates.

TABLE 8

| Name | SEQ ID NO. | Description | Sequence (5'→3') |
| --- | --- | --- | --- |
| P577 | 536 | Forward primer used to amplify the targeted region | GAGGCTGGAGAGGCCCGT |
| P578 | 537 | Reverse primer used to amplify the targeted region | GATTTTCATGCAGGTGCTGAAA |
| P577 | 536 | Sanger sequencing primer | GAGGCTGGAGAGGCCCGT |

Primers used for base edit analysis of the effect of UGI in HEK293T

TABLE 9a

Primers used to amplify targeted regions in HEK293T cells transfected with A0A2K5RND7-MG nickase-MG69-1

| Name | SEQ ID NO. | Description | Sequence (5'→3') |
| --- | --- | --- | --- |
| P969 | 538 | Forward primer used to amplify A0A2K5RDN7-nSpCas9 (D10A)-MG69-1_site 1 | GCTCTTCCGATCTNNNNNAGGAGGAAGGGCCTGAGT |
| P970 | 539 | Reverse primer used to amplify A0A2K5RDN7-nSpCas9 (D10A)-MG69-1_site 1 | GCTCTTCCGATCTNNNNNTCTGCCCTCGTGGGTTTG |
| P971 | 540 | Forward primer used to amplify A0A2K5RDN7-nSpCas9 (D10A)-MG69-1_site 2 | GCTCTTCCGATCTNNNNNCTCTGGCCACTCCCTGGC |
| P972 | 541 | Reverse primer used to amplify A0A2K5RDN7-nSpCas9 (D10A)-MG69-1_site 2 | GCTCTTCCGATCTNNNNNGGCAGGCTCTCCGAGGAG |
| P973 | 542 | Forward primer used to amplify A0A2K5RDN7-nSpCas9 (D10A)-MG69-1_site 3 | GCTCTTCCGATCTNNNNNGGGAATAATAAAAGTCTCTCTCTTAA |
| P974 | 543 | Reverse primer used to amplify A0A2K5RDN7-nSpCas9 (D10A)-MG69-1_site 3 | GCTCTTCCGATCTNNNNNCCCCCTCCACCAGTACCC |
| P975 | 544 | Forward primer used to amplify A0A2K5RDN7-nSpCas9 (D10A)-MG69-1_site 4 | GCTCTTCCGATCTNNNNNCCTGTCCTTGGAGAACCG |
| P976 | 545 | Reverse primer used to amplify A0A2K5RDN7-nSpCas9 (D10A)-MG69-1_site 4 | GCTCTTCCGATCTNNNNNGCAGGTGAACACAAGAGCT |
| P977 | 546 | Forward primer used to amplify A0A2K5RDN7-nSpCas9 (D10A)-MG69-1_site 5 | GCTCTTCCGATCTNNNNNGAAGGTGTGGTTCCAGAAC |
| P978 | 547 | Reverse primer used to amplify A0A2K5RDN7-nSpCas9 (D10A)-MG69-1_site 5 | GCTCTTCCGATCTNNNNNTCGATGTCCTCCCCATTG |
| P979 | 548 | Forward primer used to amplify A0A2K5RDN7-nMG1-4 (D9A)-MG69-1_site 1 | GCTCTTCCGATCTNNNNNAAACAGGCTAGACATAGGGA |
| P980 | 549 | Reverse primer used to amplify A0A2K5RDN7-nMG1-4 (D9A)-MG69-1_site 1 | GCTCTTCCGATCTNNNNNGAAGCCACCAGAGTCTCTA |
| P981 | 550 | Forward primer used to amplify A0A2K5RDN7-nMG1-4 (D9A)-MG69-1_site 2 | GCTCTTCCGATCTNNNNNGCCGCCATTGACAGAGGG |
| P982 | 551 | Reverse primer used to amplify A0A2K5RDN7-nMG1-4 (D9A)-MG69-1_site 2 | GCTCTTCCGATCTNNNNNGCATCAAAACAAAAGGGAGATTG |

TABLE 9a-continued

Primers used to amplify targeted regions in HEK293T cells transfected with A0A2K5RND7-MG nickase-MG69-1

| Name | SEQ ID NO. | Description | Sequence (5'→3') |
|---|---|---|---|
| P983 | 552 | Forward primer used to amplify A0A2K5RDN7-nMG1-4 (D9A)-MG69-1_site 3 | GCTCTTCCGATCTNNNNNCCTCTGCCCACCTCACTT |
| P984 | 553 | Reverse primer used to amplify A0A2K5RDN7-nMG1-4 (D9A)-MG69-1_site 3 | GCTCTTCCGATCTNNNNNGCCATGTGGGTTAATCTGG |
| P985 | 554 | Forward primer used to amplify A0A2K5RDN7-nMG1-4 (D9A)-MG69-1_site 4 | GCTCTTCCGATCTNNNNNCCGGACGCACCTACCCAT |
| P986 | 555 | Reverse primer used to amplify A0A2K5RDN7-nMG1-4 (D9A)-MG69-1_site 4 | GCTCTTCCGATCTNNNNNCTAGATGGGAATGGATGGG |
| P987 | 556 | Forward primer used to amplify A0A2K5RDN7-nMG3-6 (D13A)-MG69-1_site 1 | GCTCTTCCGATCTNNNNNAACCACAAACCCACGAGG |
| P988 | 557 | Reverse primer used to amplify A0A2K5RDN7-nMG3-6 (D13A)-MG69-1_site 1 | GCTCTTCCGATCTNNNNNTCAATGGCGGCCCCGGGC |
| P989 | 558 | Forward primer used to amplify A0A2K5RDN7-nMG3-6 (D13A)-MG69-1_site 2 | GCTCTTCCGATCTNNNNNAGTGATCCCCAGTGTCCC |
| P990 | 559 | Reverse primer used to amplify A0A2K5RDN7-nMG3-6 (D13A)-MG69-1_site 2 | GCTCTTCCGATCTNNNNNGCCCTGAACGCGTTTGCT |
| P991 | 560 | Forward primer used to amplify A0A2K5RDN7-nMG3-6 (D13A)-MG69-1_site 3 | GCTCTTCCGATCTNNNNNTGGGAATAATAAAAGTCTCTCTCT |
| P992 | 561 | Reverse primer used to amplify A0A2K5RDN7-nMG3-6 (D13A)-MG69-1_site 3 | GCTCTTCCGATCTNNNNNCCCCTCCACCAGTACCCC |
| P993 | 562 | Forward primer used to amplify A0A2K5RDN7-nMG3-6 (D13A)-MG69-1_site 4 | GCTCTTCCGATCTNNNNNCAGGGCCTCCTCAGCCCA |
| P994 | 563 | Reverse primer used to amplify A0A2K5RDN7-nMG3-6 (D13A)-MG69-1_site 4 | GCTCTTCCGATCTNNNNNGTCTGGATGTCGTAAGGGAA |
| P995 | 564 | Forward primer used to amplify A0A2K5RDN7-nMG3-6 (D13A)-MG69-1_site 5 | GCTCTTCCGATCTNNNNNGGGGTGTAACTCAGAATGTTTT |
| P996 | 565 | Reverse primer used to amplify A0A2K5RDN7-nMG3-6 (D13A)-MG69-1_site 5 | GCTCTTCCGATCTNNNNNGGGAGTGAGACTCAGAGA |
| P997 | 566 | Forward primer used to amplify A0A2K5RDN7-nMG3-6 (D13A)-MG69-1_site 6 | GCTCTTCCGATCTNNNNNGCAAAGAGGGAAATGAGATCA |
| P998 | 567 | Reverse primer used to amplify A0A2K5RDN7-nMG3-6 (D13A)-MG69-1_site 6 | GCTCTTCCGATCTNNNNNGTGACACATTTGTTTGAGAATCA |
| P999 | 568 | Forward primer used to amplify A0A2K5RDN7-nMG3-6 (D13A)-MG69-1_site 7 | GCTCTTCCGATCTNNNNNCTTTATCCCCGCACAGAG |
| P1000 | 569 | Reverse primer used to amplify A0A2K5RDN7-nMG3-6 (D13A)-MG69-1_site 7 | GCTCTTCCGATCTNNNNNCTTGGCCCATGGGAAATC |

TABLE 9a-continued

Primers used to amplify targeted regions in HEK293T cells transfected with A0A2K5RND7-MG nickase-MG69-1

| Name | SEQ ID NO. | Description | Sequence (5'→3') |
|---|---|---|---|
| P1001 | 570 | Forward primer used to amplify A0A2K5RDN7-nMG4-2 (D28A)-MG69-1_site 1 | GCTCTTCCGATCTNNNNNGTCCCATCCCAACACCCC |
| P1002 | 571 | Reverse primer used to amplify A0A2K5RDN7-nMG4-2 (D28A)-MG69-1_site 1 | GCTCTTCCGATCTNNNNNTGGGCATGTGTGCTCCCA |
| P1003 | 572 | Forward primer used to amplify A0A2K5RDN7-nMG4-2 (D28A)-MG69-1_site 2 | GCTCTTCCGATCTNNNNNCTATGGGAATAATAAAAGTCTCTC |
| P1004 | 573 | Reverse primer used to amplify A0A2K5RDN7-nMG4-2 (D28A)-MG69-1_site 2 | GCTCTTCCGATCTNNNNNCTCCACCAGTACCCCACC |
| P1005 | 574 | Forward primer used to amplify A0A2K5RDN7-nMG4-2 (D28A)-MG69-1_site 3 | GCTCTTCCGATCTNNNNNGGACCCTGGTCTCTACCT |
| P1006 | 575 | Reverse primer used to amplify A0A2K5RDN7-nMG4-2 (D28A)-MG69-1_site 3 | GCTCTTCCGATCTNNNNNCCTCTCCCATTGAACTACC |
| P1007 | 576 | Forward primer used to amplify A0A2K5RDN7-nMG4-2 (D28A)-MG69-1_site 4 | GCTCTTCCGATCTNNNNNCCCCAGTGACTCAGGGCC |
| P1008 | 577 | Reverse primer used to amplify A0A2K5RDN7-nMG4-2 (D28A)-MG69-1_site 4 | GCTCTTCCGATCTNNNNNTCGTAAGGGAAAGACTTAGGAA |
| P1009 | 578 | Forward primer used to amplify A0A2K5RDN7-nMG18-1 (D12A)-MG69-1_site 1 | GCTCTTCCGATCTNNNNNTCTCCCTTTTGTTTTGATGCATTT |
| P1010 | 579 | Reverse primer used to amplify A0A2K5RDN7-nMG18-1 (D12A)-MG69-1_site 1 | GCTCTTCCGATCTNNNNNCCACCCCAGGCTCTGGGG |
| P1011 | 580 | Forward primer used to amplify A0A2K5RDN7-nMG18-1 (D12A)-MG69-1_site 2 | GCTCTTCCGATCTNNNNNCCTTTTGTTTTGATGCATTTCTGTTT |
| P1012 | 581 | Reverse primer used to amplify A0A2K5RDN7-nMG18-1 (D12A)-MG69-1_site 2 | GCTCTTCCGATCTNNNNNAATCTACCACCCCAGGCT |
| P1013 | 582 | Forward primer used to amplify A0A2K5RDN7-nMG18-1 (D12A)-MG69-1_site 3 | GCTCTTCCGATCTNNNNNATCCCCAGTGTCCCCCTT |
| P1014 | 583 | Reverse primer used to amplify A0A2K5RDN7-nMG18-1 (D12A)-MG69-1_site 3 | GCTCTTCCGATCTNNNNNCCAGGCCCTGAACGCGTT |
| P1015 | 584 | Forward primer used to amplify A0A2K5RDN7-nMG18-1 (D12A)-MG69-1_site 4 | GCTCTTCCGATCTNNNNNAGGCCAGGCCTGCGGGGG |
| P1016 | 585 | Reverse primer used to amplify A0A2K5RDN7-nMG18-1 (D12A)-MG69-1_site 4 | GCTCTTCCGATCTNNNNNCCAAAAACTCCCAAATTAGCAAA |

PCR products were purified using the HighPrep PCR Clean-up System (MAGBIO) per manufacturer's instructions. The effect of uracil glycosylase inhibitor (UGI) on base editing of candidate enzymes was analyzed by submitting PCR products to Elim BIOPHARM for Sanger sequencing, and the efficiency was quantified by Edit R. To analyze base editing of A0A2K5RND7-MG nickase-MG69-1, adapters used for next generation sequencing (NGS) were appended to PCR products by subsequent PCR reactions using KAPA HiFi HotStart ReadyMix PCR Kit (Roche) and primers compatible with TruSeq™ DNA Library Prep Kits (illumina). DNA concentrations of the resulting products were quantified by TapeStation (Agilent), and samples were pooled together to prepare the library for NGS analysis. The resulting library was quantified by qPCR with Aria Real-time PCR System (Agilent) and high through sequencing was performed with an Illumina Miseq instrument per manufacturer's instructions. Sequencing data was analyzed for base edits by Cripresso2.

Figure 13A:
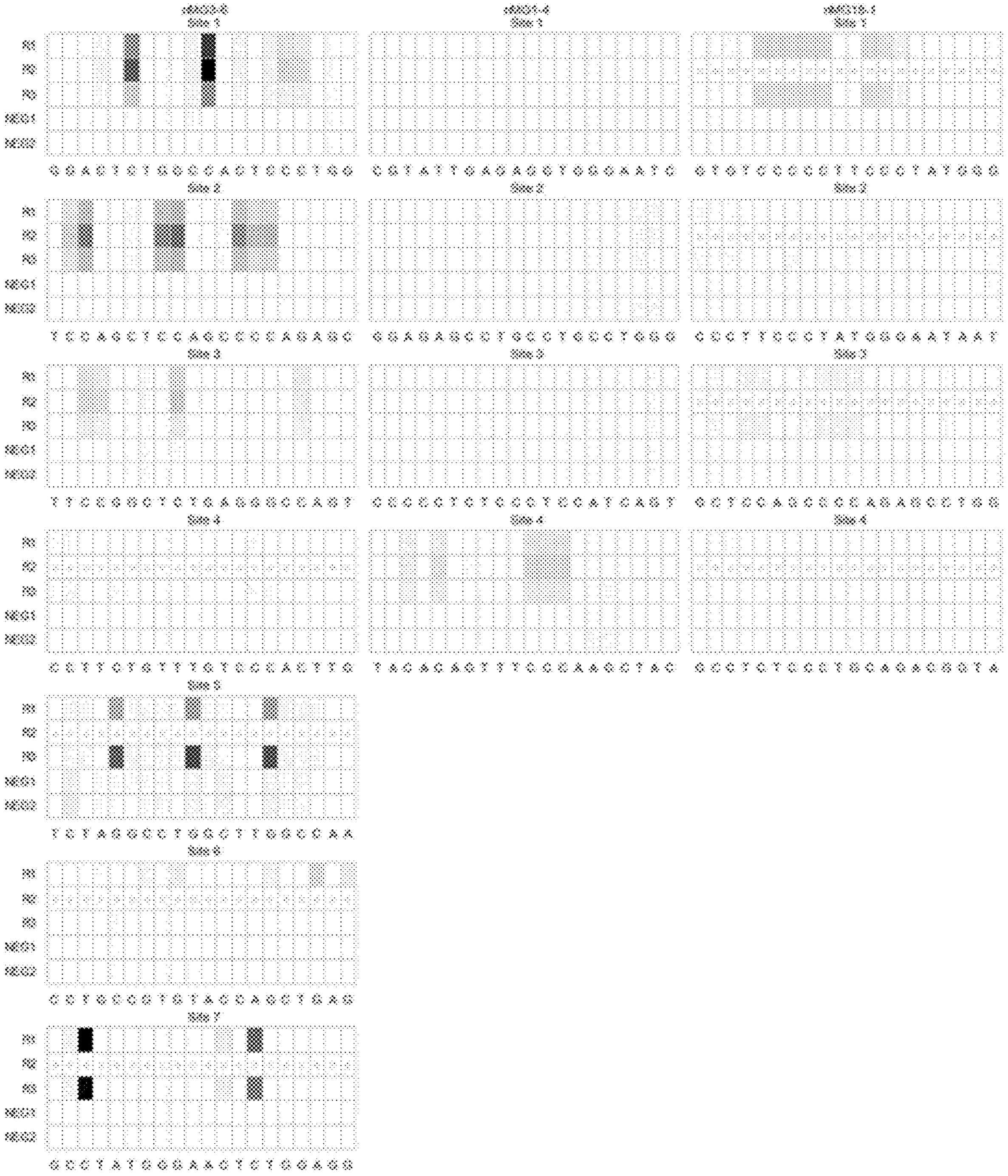
FIGS. 13A (SEQ ID NOs: 1768-1782) and 13B (SEQ ID NOs: 1783-1788) depicts maps of edited sites showing editing efficiencies of cytosine base editors comprising A0A2K5RDN7, an MG nickases, and an MG UGI. The constructs comprise an N-terminal A0A2K5RDN7, an MG nickases, and a C-terminal MG69-1. For simplicity, the identities of MG nickases are shown in the figure. BE3 was used as the positive control for base editing. An empty vector was used for the negative control. Three independent experiments were performed on different days. Abbreviations: R, repeat; NEG, negative control.
Figure 13B:
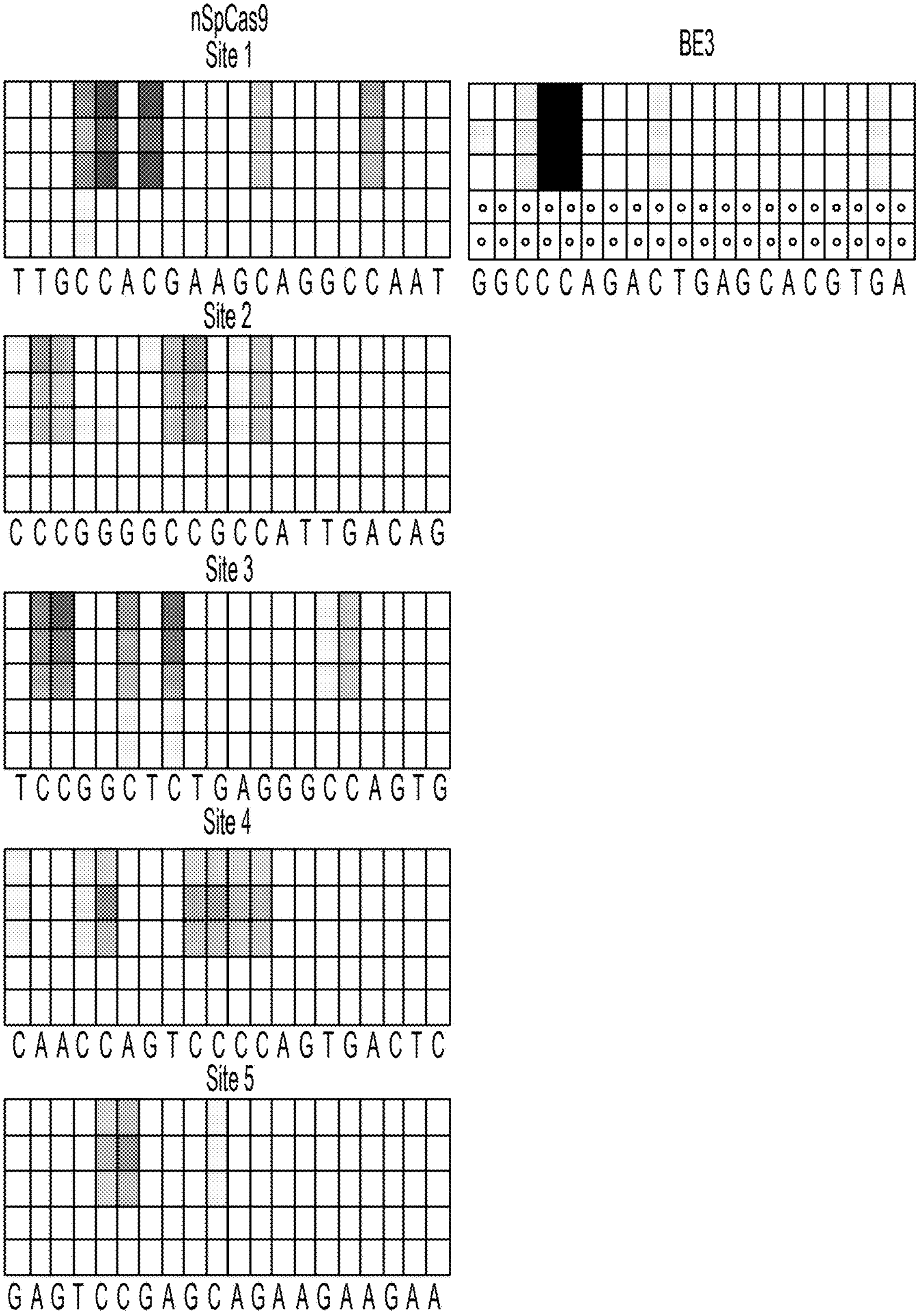

FIGS. 13A-13B shows maps of sites targeted by base editors showing base editing efficiencies of cytosine base editors comprising CMP/dCMP-type deaminase domain-containing protein (uniprot accession A0A2K5RDN7), MG nickases, and MG UGI. The constructs comprise N-terminal A0A2K5RDN7, MG nickases, and C-terminal MG69-1. For simplicity, the identities of MG nickases are shown in the figure. BE3 (APOBEC1) was used as a positive control for base editing. An empty vector was used for the negative control. Three independent experiments were performed on different days. Abbreviations: R, repeat; NEG, negative control.

TABLE 9b

Protein Domains used in constructs in Example 13

| Candidate | Type | PAM | Deaminase | Linker (Deaminase-Nickase) | Nickase | UGI | Linker (Nickase-UGI) |
|---|---|---|---|---|---|---|---|
| A0A2K5RDN7-nMG3-6-MG69-1 | II | nnRGGnT Sequence Number: A362 | A0A2K5RDN7 SEQ ID NO: 594 | SGSETPGT SESATPES (SEQ ID NO: 590) | InMG3-6 (D13A) SEQ ID NO: 71 | MG69-1 SEQ ID NO: 52 | SGGSS (SEQ ID NO: 1871) |
| A0A2K5RDN7-nMG1-4-MG69-1 | II | nRRR Sequence Number: A360 | A0A2K5RDN7 SEQ ID NO: 594 | SGSETPGT SESATPES (SEQ ID NO: 590) | nMG1-4 SEQ ID NO: 70 | MG69-1 SEQ ID NO: 52 | SGGSS (SEQ ID NO: 1871) |
| A0A2K5RDN7-nMG18-1-MG69-1 | II | nRWART Sequence Number: A368 | A0A2K5RDN7 SEQ ID NO: 594 | SGSETPGT SESATPES (SEQ ID NO: 590) | nMG18-1 SEQ ID NO: 78 | MG69-1 SEQ ID NO: 52 | SGGSS (SEQ ID NO: 1871) |

Example 14—Positive Selection of Base Editor Mutants in *E. coli*

Figure 14A:
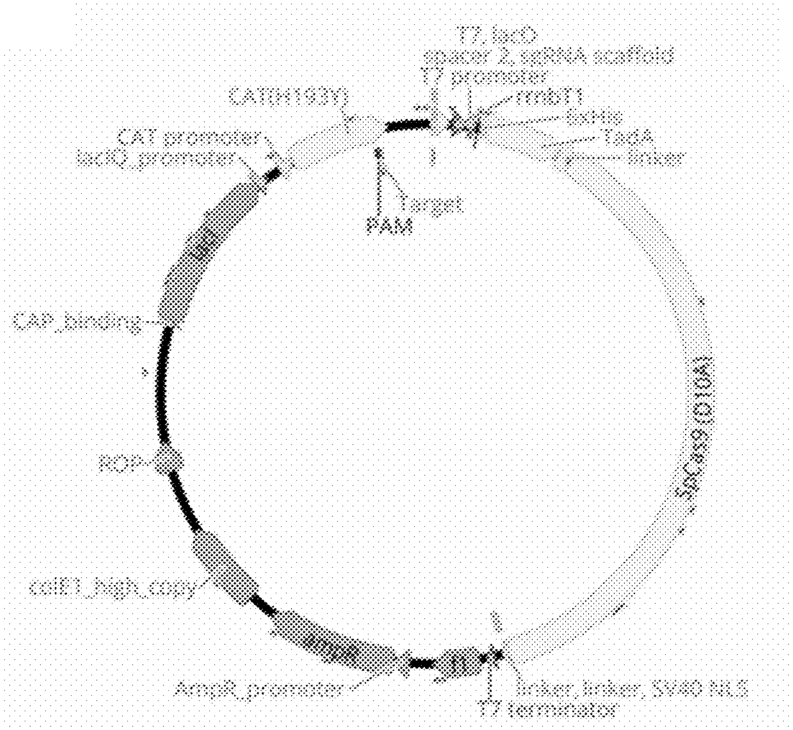
FIGS. 14A (SEQ ID NO: 1874) and 14B (SEQ ID NOs: 1789 and 1790) shows a positive selection method for TadA characterization in *E. coli*.
Figure 14B:
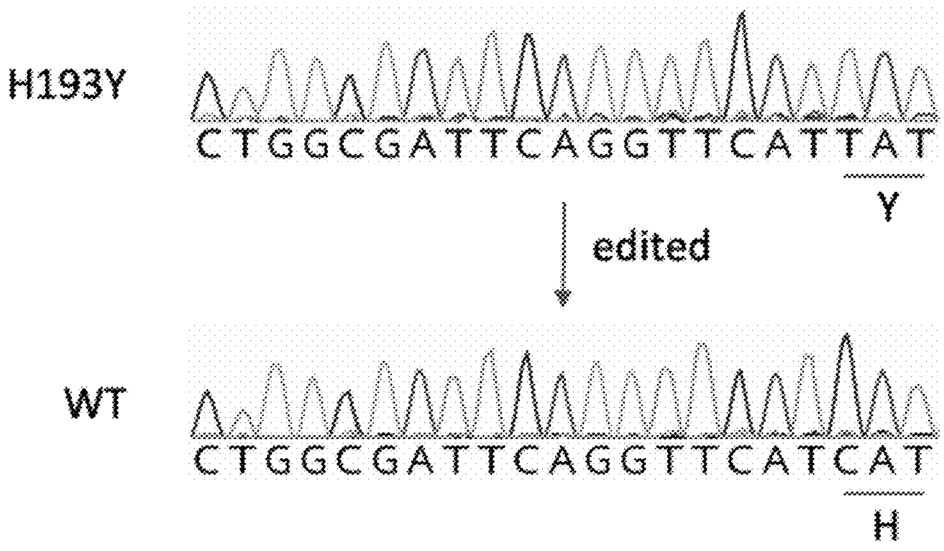
FIG. 14B shows sequencing traces demonstrating that when introduced/transformed into *E. coli* cells, the A2 position of CAT (H193Y)'s template strand is edited, reverting the H193Y mutant to wild type and restoring its activity. Abbreviations: CAT, chloramphenicol acetyltransferase.

FIGS. 14A-B show a positive selection method for TadA characterization in *E. coli*. FIG. 14A shows a map of one plasmid system used for TadA selection. The vector comprises CAT (H193Y), a sgRNA expression cassette targeting CAT, and an ABE expression cassette. In this figure, N-terminal TadA from *E. coli* and a C-terminal SpCas9 (D10A) from *Streptococcus pyogenes* are shown. FIG. 14B shows sequencing traces demonstrating that when introduced/transformed into *E. coli* cells, the A2 position of CAT (H193Y)'s template strand is edited, reverting the H193Y mutant to wild type and restoring its activity. Abbreviations: CAT, chloramphenicol acetyltransferase.

1 µL of plasmid solution with a concentration of 10 ng/µL was transformed into 25 µL BL21 (DE3) electrocompetent cells (Lucigen), recovered with 975 µL expression recovery medium at 37° C. for 1 h. 50 µL of the resulting cells were spread on a LB agar plate containing 100 µg/mL carbenicillin, 0.1 mM IPTG, and appropriate amount of chloramphenicol. The plate was incubated at 37° C. until colonies were pickable. Colony PCR were used to amplify the genomic region containing base edits, and the resulting products were submitted for Sanger sequencing at ELIM BIOPHARM. Primers used for PCR and sequencing are listed in Table 10 (SEQ ID NOs. 532-537).

TABLE 10

Primers used for base edit analysis of CAT (H193Y)

| Name | SEQ ID NO. | Description | Sequence (5'→3') |
|---|---|---|---|
| P570 | 532 | Forward primer used to amplify CAT (H193Y) of CAT (H193Y)-sgRNA-MG68-4 variant-nSpCas9 (D10A) | CCGCCGCCGCAAGGAATGGTTT AATTAATTTGATCGGCACGTAAG AGG |
| P1050 | 534 | Forward primer used to amplify CAT (H193Y) of CAT (H193Y)-sgRNA-MG68-4 variant-nMG34-1 (D10A) | AAGGAATGGTTTAATTAATTCTA GATTAATTAATTTGATCGGCACG TAAG |
| P571 | 533 | Reverse primer used to amplify CAT (H193Y) of CAT (H193Y)-sgRNA-MG68-4 variant-nSpCas9 | GGACTGTTGGGCGCCATCTCCTT GCATGCTTCACTTATTCAGGCGT AGCA |
| P571 | 535 | Sanger sequencing primer of CAT (H193Y) | GGACTGTTGGGCGCCATCTCCT TGCATGCTTCACTTATTCAGGCG TAGCA |

Figures 15A, 15B:
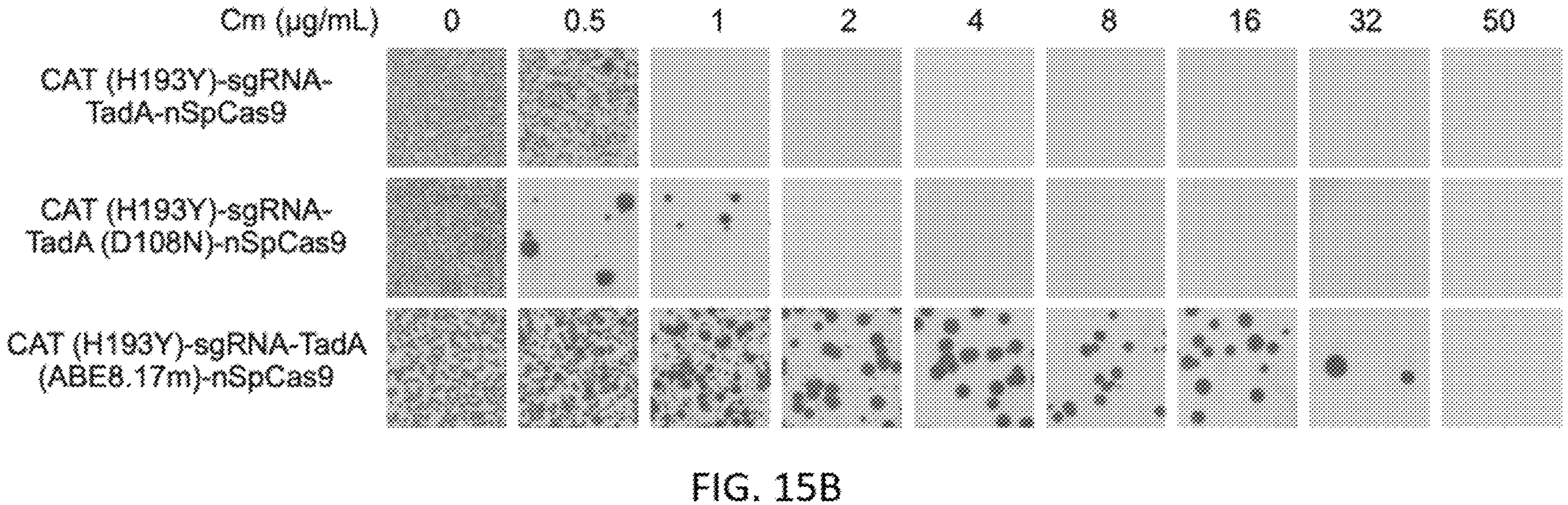
FIGS. 15A and 15B shows mutations caused by TadA enable high tolerance of chloramphenicol (Cm).

FIGS. 15A-B shows mutations caused by TadA enable high tolerance of chloramphenicol (Cm). FIG. 15A shows photographs of growth plates where different concentrations of chloramphenicol were used to select for antibiotics resistance of *E. coli*. In this example, wild type and two variants of TadA from *E. coli* (EcTadA) were tested. FIG. 15B shows a results summary table demonstrating that ABEs carrying mutated TadA show higher editing efficiencies than the wild type. In these experiments, colonies were picked from the plates with greater than or equal to 0.5 μg/mL Cm. For simplicity, identities of deaminases are shown in the table, but effectors (SpCas9) and construct organization are shown in the figures above.

Figure 16A:
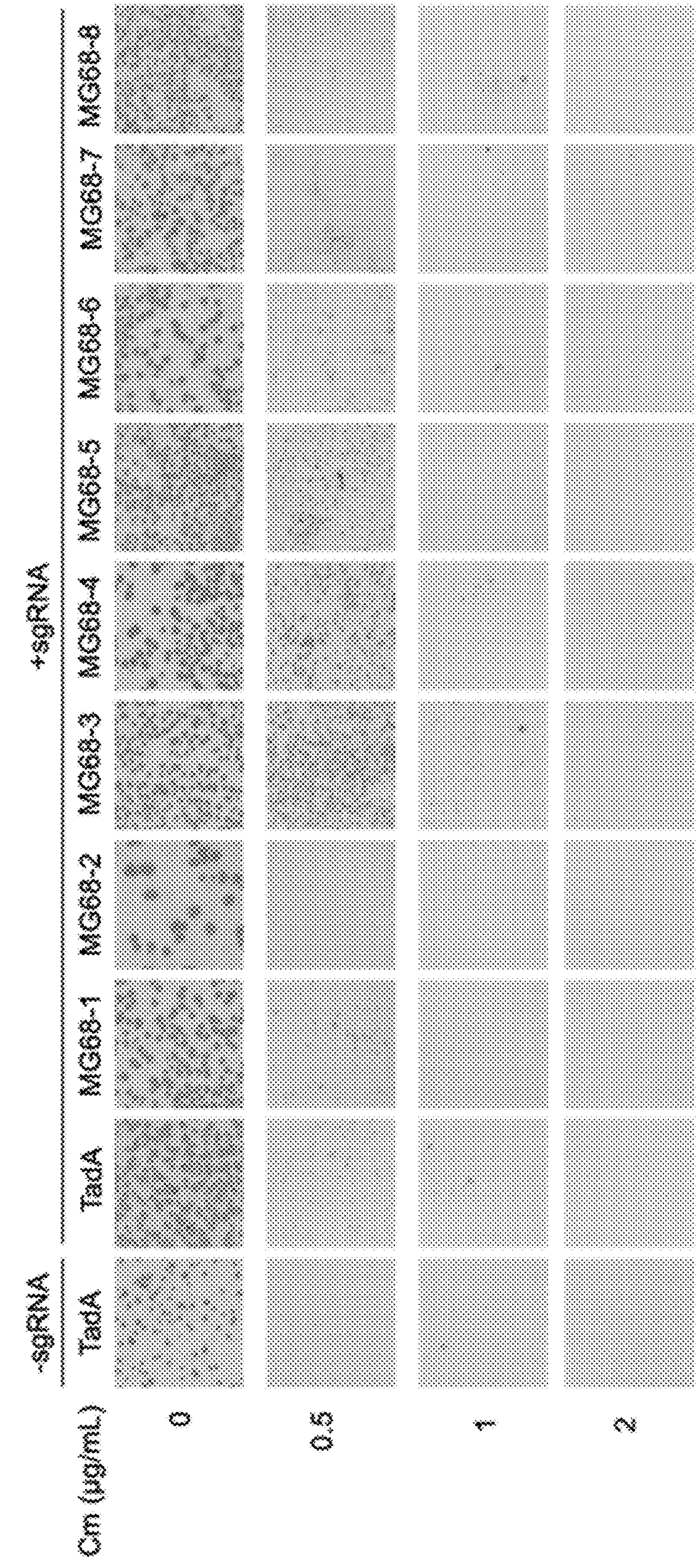
FIG. 16A shows photographs of growth plates to investigate MG TadA activity in positive selection. 8 MG68 TadA candidates were tested against 0 to 2 μg/mL of chloramphenicol (ABEs comprised N-terminal TadA variants and C-terminal SpCas9 (D10A) nickase). For simplicity, identities of deaminases are shown. In this experiment, colonies were picked from the plates with greater than or equal to 0.5 μg/mL Cm.

FIGS. 16A-16B shows investigation of MG TadA activity in positive selection. FIG. 16A shows photographs of growth plates from an experiment where 8 MG68 TadA candidates were tested against 0 to 2 μg/mL of chloramphenicol (ABEs comprised N-terminal TadA variants and C-terminal SpCas9 (D10A) nickase). For simplicity, identities of deaminases are shown. Panel (b) shows a summary table depicting editing efficiencies of MG TadA candidates. FIG. 16B demonstrates that MG68-3 and MG68-4 drove base edits of adenine. In this experiment, colonies were picked from the plates with greater than or equal to 0.5 μg/mL Cm.

Figures 17A, 17B:
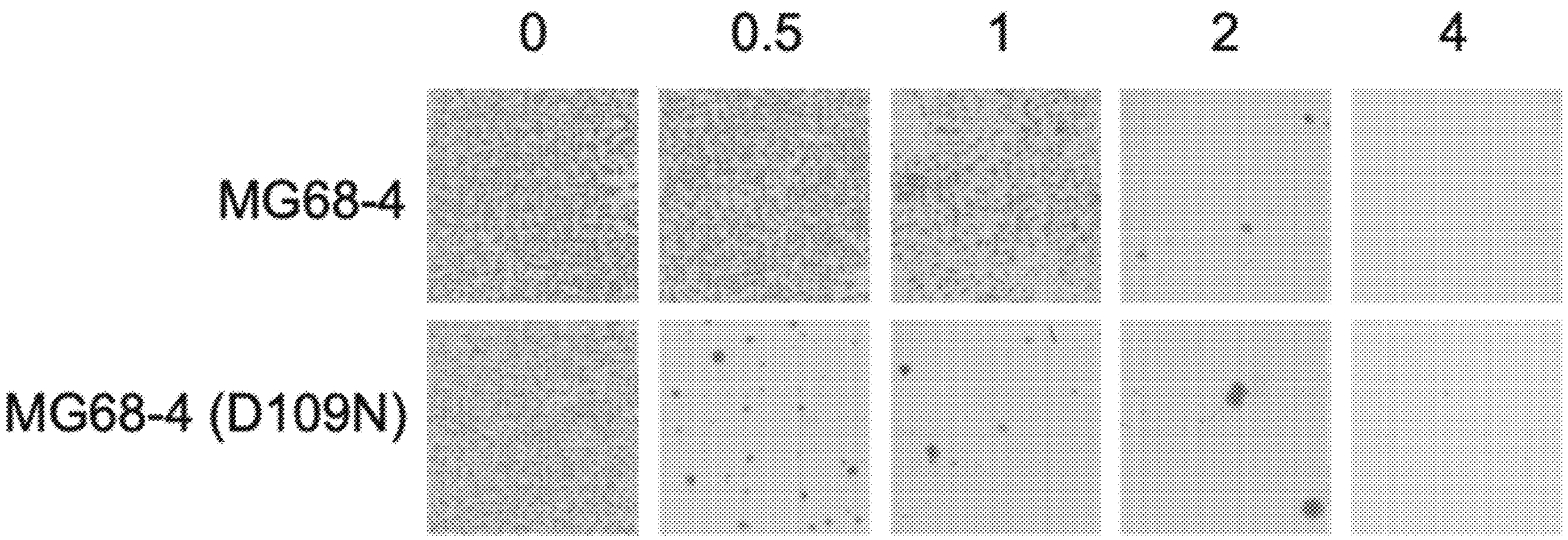
FIGS. 17A and 17B shows an improvement of base editing efficiency of MG68-4_nSpCas9 via D109N mutation on MG68-4.

FIG. 17 shows an improvement of base editing efficiency of MG68-4 nSpCas9 via D109N mutation on MG68-4. Panel (a) shows photographs of growth plates where wild type MG68-4 and its variant were tested against 0 to 4 μg/mL of chloramphenicol. For simplicity, identities of deaminases are shown. Adenine base editors in this experiment comprise N-terminal TadA variants and C-terminal SpCas9 (D10A) nickase. Panel (b) shows a summary table depicting editing efficiencies of MG TadA candidates. Panel (b) demonstrates that MG68-4 and MG68-4 (D109N) showed base edits of adenine, with the D109N mutant showing increased activity. In this experiment, colonies were picked from the plates with greater than or equal to 0.5 μg/mL Cm.

Figures 18A, 18B:
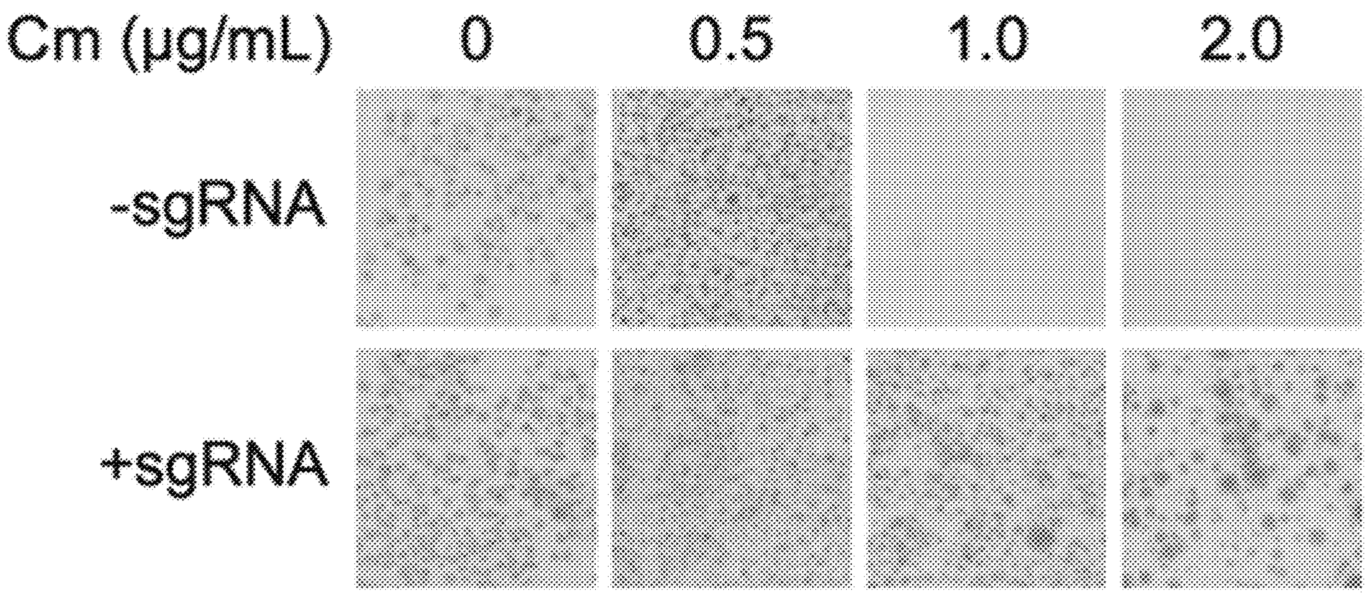
FIGS. 18A and 18B show base editing of MG68-4 (D109N)_nMG34-1.

FIG. 18 shows base editing of MG68-4 (D109N) _nMG34-1. Panel (a) shows photographs of growth plates of an experiment where an ABE comprising N-terminal MG68-4 (D109N) and C-terminal SpCas9 (D10A) nickase was tested against 0 to 2 μg/mL of chloramphenicol. Panel (b) shows a summary table depicting editing efficiencies with and without sgRNA. In this experiment, colonies were picked from the plates with greater than or equal to 1 μg/mL Cm.

FIG. 19 shows 28 MG68-4 variants designed for improvements of MG68-4-nMG34-1 base editing activity. 12 residues were selected for targeted mutagenesis to improve editing of the enzymes.

Example 15—Plasmid Construction for *E. coli* Optimized Constructs

All plasmids for cytidine deaminase expression were prepared by Twist Biosciences. Each construct was codon optimized for *E. coli* expression and inserted into the XhoI and BamHI restriction sites of the pET-21(+) vector. Sequences were designed to exclude BsaI restriction sites. The following sequence was appended to the beginning of each construct: 5'-GAAATAATTTTGTTTAACTT-TAAGAAGGAGATATACATATGGGCAGCAGTCAT-CATC ATCACCATCAC-3' (SEQ ID NO: 1873). This sequence encodes a ribosomal binding site and an N-terminal hexahistidine tag (SEQ ID NO: 1874). At the end of each CDA sequence, a stop codon was added to prevent incorporation of the C-terminal HisTag encoded by pET-21(+).

Example 16—Plasmid Construction for Mammalian Optimized Constructs

All plasmids for cytidine deaminase expression in mammalian cells were codon optimized and ordered from Twist Biosciences. Each construct was codon optimized for *H. sapiens* expression. Restriction sites avoided were: BsaI, SphI, EcoRI, BmtI, BstX, BlpI and BamHI. The following sequence was appended 5' of the codon optimized sequences: ACCGGTGCTAGCCCACC (SEQ ID NO: 1875). This sequence contains a BmtI restriction site to be used for downstream cloning and a Kozak sequence for maximum translation. The following sequence was appended 3' of the codon optimized CDA: AGCGCATGC. This sequence contains a SphI restriction site to allow for downstream cloning—stop codon was removed in all constructs.

Example 17—Cell Culture, Transfections, Next Generation Sequencing, and Base Edit Analysis HEK293T cells were grown and passaged in Dulbecco's Modified Eagle's Medium plus GlutaMAX™ (gibco) supplemented with 10% (v/v) fetal bovine serum (gibco) at 37° C. with 5% $CO_2$. $2.5\times10^4$ cells were seeded on 96-well cell culture plates treated for cell attachment (Costar). grown for 20 to 24 h, and the spent media were refreshed with new media right before transfection. 300 ng expression plasmid and 1 μL Lipofectamine™ 2000 (ThermoFisher Scientific) were used for transfection per well per manufacturer's instructions. Transfected cells were grown for 3 days harvested, and gDNA was extracted with QuickExtract (Lucigen) per manufacturer's instructions. Targeted regions for base edits were amplified using Q5® High-Fidelity DNA polymerase (New England Biolabs) with primers (SEQ ID NOs: 690-707, 865-872, and 932-961) and extracted DNA as templates. PCR products were purified by HighPrep PCR Clean-up System (MAGBIO) per manufacturer's instructions. To analyze base substitutions of adenine base editors, adapters used for next generation sequencing (NGS) were appended to PCR products by subsequent PCR reactions using KAPA HiFi HotStart ReadyMix PCR Kit (Roche) and primers compatible with TruSeq™ DNA Library Prep Kits (illumina). DNA concentrations of the resulting products were quantified by TapeStation (Agilent), and samples were pooled together to prepare the library for NGS analysis. The resulting library was quantified by qPCR with Aria Real-time PCR System (Agilent) and high through sequencing was performed with an Illumina Miseq instrument per manufacturer's instructions. Sequencing data was analyzed for base edits by Crispresso2.

Example 18—In Vitro Deaminase In-Gel Assay

Figure 20:
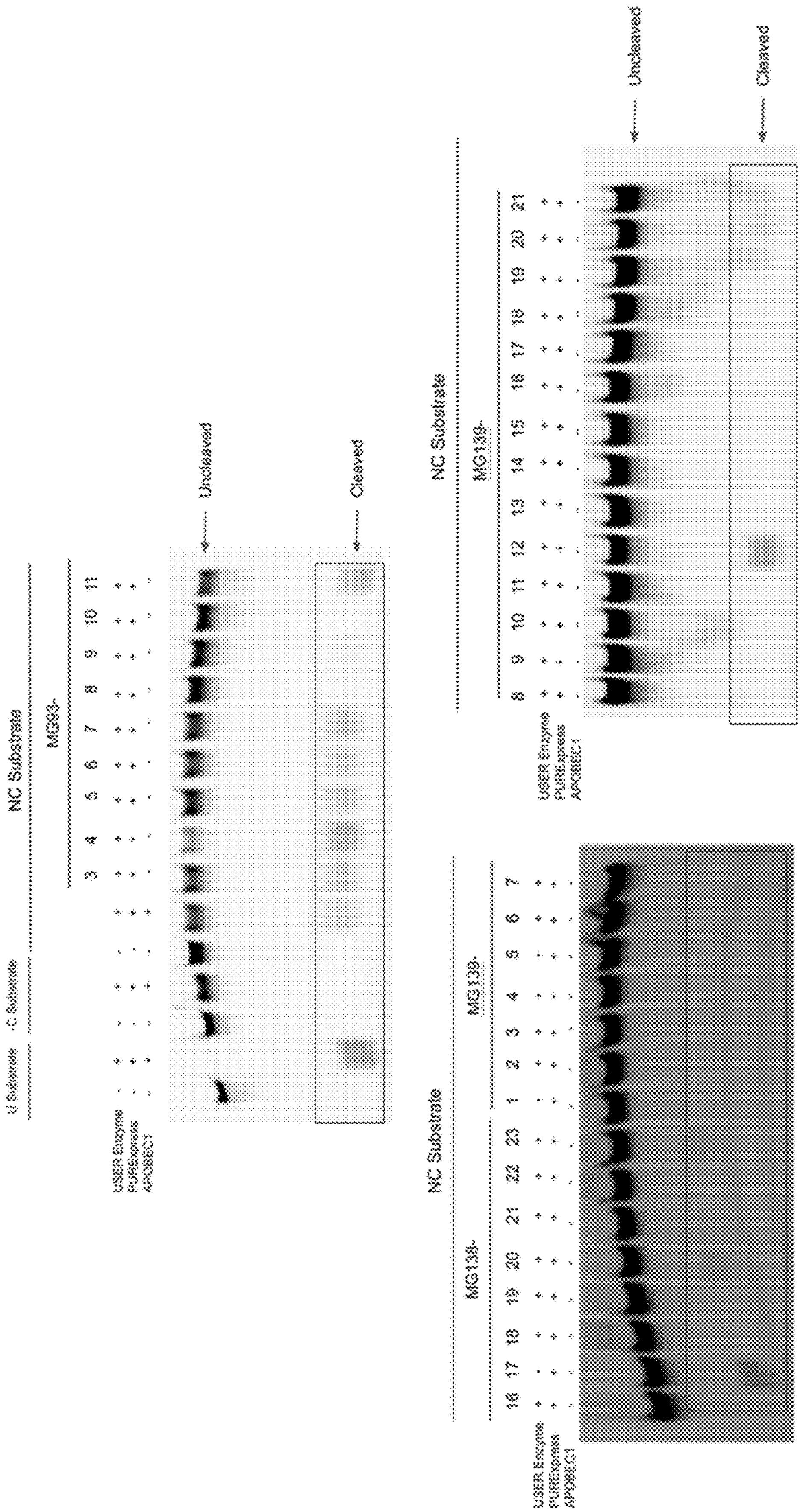
FIG. 20 shows the results of a gel-based deaminase assay showing activity of deaminases from several selected Families (MG93, MG138, and MG139). Enzymes were expressed in a bacterial (*E. coli* codon optimized) Purexpress cell lysate-derived in vitro transcription-translation system and incubated with 5'FAM-labeled ssDNA and USER enzyme (uracil DNA glycosylase and endonuclease VIII) at 37° C. for 2.5 h. The resulting DNA was resolved on a denaturing polyacrylamide gel and imaged. The positive control is a sequence with a U synthetically incorporated at the same position as the target C and the negative control is a sequence with no U or C.

Linear DNA constructs containing the cytidine deaminases were amplified from the previously mentioned plasmids from Twist via PCR_. All constructs were cleaned via SPRI Cleanup (Lucigen) and eluted in a 10 mM tris buffer. Enzymes were expressed from the PCR templates in an in-vitro transcription-translation system, PURExpress (NEB), at 37'C for 2 hours. Deamination reactions were prepared by mixing 2 uLs of the PURExpress reaction with 2 uM 5'FAM labeled ssDNA (IDT) and IU USER Enzyme (NEB) in 1× Cutsmart Buffer (NEB) The reactions were incubated at 37° C. for 2 hours and then quenched by adding 4 units of proteinase K (NEB) and incubation at 55° C. for 10 minutes. The reaction was further treated by addition of 11 μL of 2×RNA loading dye and incubation at 75° C. for 10 minutes. All reaction conditions were analyzed by gel electrophoresis in a 10% denaturing gel (Biorad). DNA bands were visualized by a Chemi-Doc™ imager (Biorad) and band intensities were quantified using BioRad Image Lab™ v6.0. Successful deamination is observed by the visualization of a 10 bp fluorescently labeled band in the gel (FIG. 20). The results indicated that MG93-3 through MG93-7, MG93-11, MG138-17, MG138-20, MG138-23, MG139-12, and MG139-19 through MG139-21 were capable of deaminating cytidine-containing substrates.

Figure 23B:
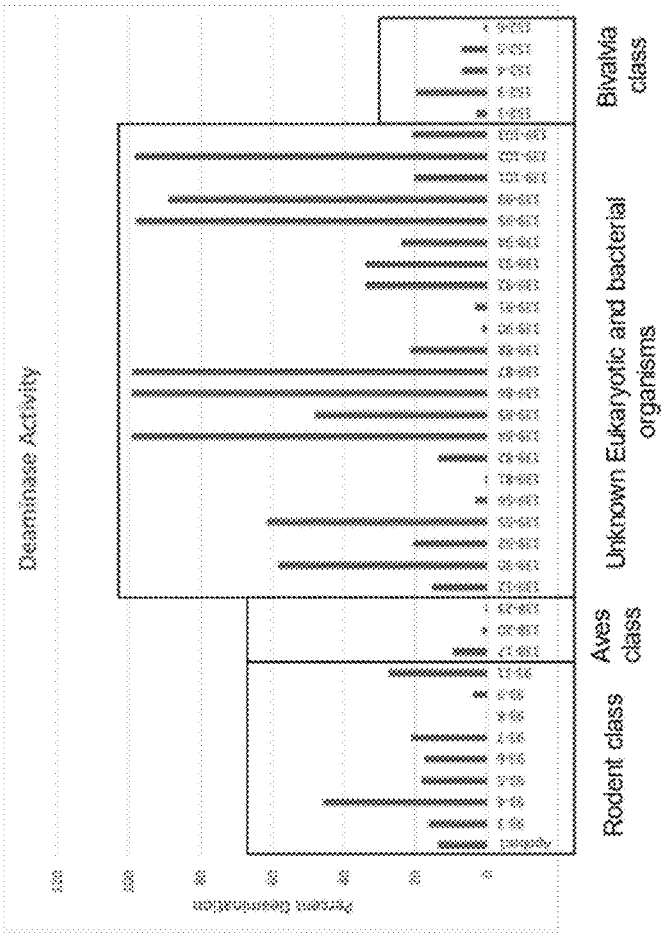
FIGS. 23A and 23B depict a gel-based deaminase assay showing activity of deaminases from one selected Family (MG139). Enzymes were expressed in a bacterial (*E. coli* codon optimized) Purexpress cell lysate-derived in vitro transcription-translation system and incubated with 5'FAM-labeled ssDNA and USER enzyme (uracil DNA glycosylase and endonuclease VIII) at 37° C. for 2.5 h. The resulting DNA was resolved on a denaturing polyacrylamide gel and imaged, which is shown in FIG. 23A. The positive control is a sequence with a U synthetically incorporated at the same position as the target C and the negative control is a sequence with no U or C.
Figure 23A:
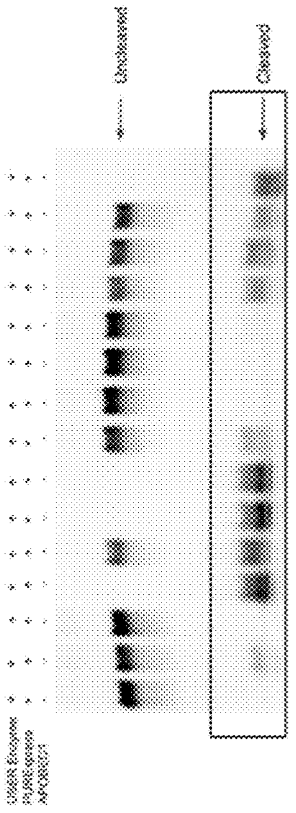
Figure 24:
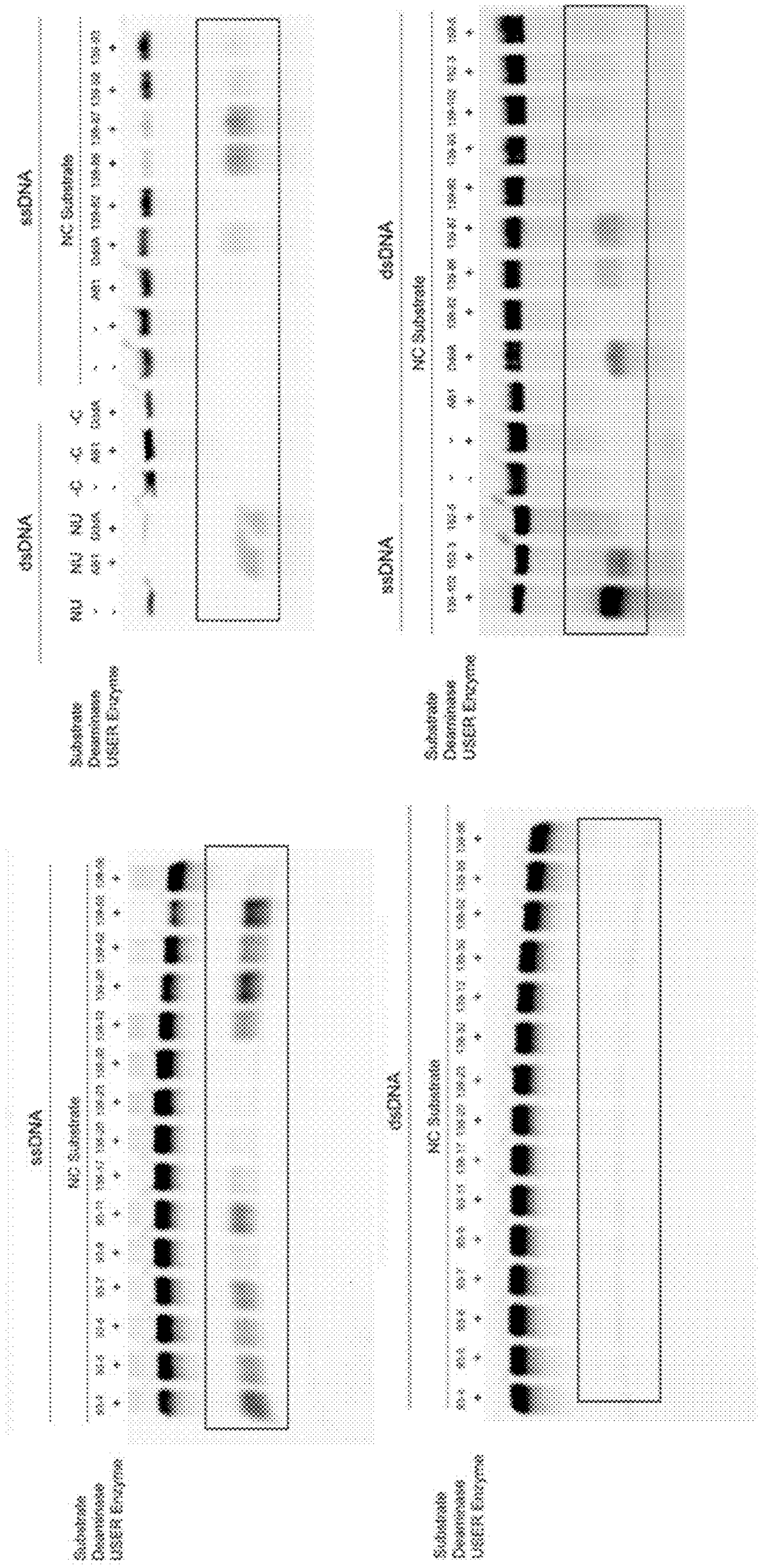
FIG. 24 depicts a gel-based deaminase assay showing ssDNA and dsDNA activities of deaminases from several selected Families (MG93, MG138 and MG139). Enzymes were expressed in a bacterial (*E. coli* codon optimized) Purexpress cell lysate-derived in vitro transcription-translation system and incubated with 5'FAM-labeled ssDNA or dsDNA and USER enzyme (uracil DNA glycosylase and endonuclease VIII) at 37° C. for 2.5 h. The resulting DNA was resolved on a denaturing polyacrylamide gel and imaged. The positive control for ssDNA activity is a sequence with a U synthetically incorporated at the same position as the target C and the negative control is a sequence with no U or C. The positive control for dsDNA activity is DddA toxin deaminase that has been documented as selective for a dsDNA substrate (Mok, B. Y., de Moraes, M. H., Zeng, J. et al. A bacterial cytidine deaminase toxin enables CRISPR-free mitochondrial base editing. Nature 583, 631-637 (2020). doi.org/10.1038/s41586-020-2477-4)

The in vitro activity of more than 90 novel cytidine deaminases on a ssDNA substrate containing cytosine in all four possible 5'-NC contexts was measured (FIG. 23). 38 of these cytidine deaminases displayed ssDNA deamination activity, including 5 that are capable of substantially total deamination of the target cytidine (MG139-84/SEQ ID NO:808, MG139-86/SEQ ID NO:810, MG139-87/SEQ ID NO:811, MG139-95/SEQ ID NO:819, and MG139-102/SEQ ID NO:826, see e.g. FIG. 23). Additionally, some of the deaminases also showed greater than 50% deamination of the target cytosine (MG139-30/SEQ ID NO:752, MG139-55/SEQ ID NO:777, MG139-99/SEQ ID NO:823). While most of the reported DNA cytidine deaminases operate predominantly on ssDNA, often with a preference for the base immediately 5' of the substrate C, a related dsDNA substrate was also included as a control (FIG. 24), verifying that MG139-86 and MG139-87 are capable of also deaminating dsDNA substrates.

Example 19—NGS-Based Deep Deamination In Vitro Assay

We created an ssDNA library with a single target C to determine cytidine deaminase activity and binding location preference. Briefly, an ssDNA substrate oligonucleotide 5'-NNNCNNN flanked by 21-nt and 21-nt regions comprising adenine, an upstream 20 nt randomized barcode, and two conserved primer binding site was synthesized (Integrated DNA Technologies).

This yielded an oligonucleotides pool with 4096 unique substrate sequences. Unique barcodes were included on each oligo to determine the original variable region post-sequencing in case of non-target C deamination events. First, deaminases were expressed from the PCR templates in an in-vitro transcription-translation system, PURExpress (NEB), at 37'C for 2 hours. Then the PURExpress was then incubated with 0.5 pmol of the substrate oligonucleotide pool for 1 h at 37° C. in 50 mM Tris, pH 7.5, 75 mM NaCl.

A. Half of the treated pool was amplified using the Accel-NGS 1S Plus kit (Swift) to create a dsDNA pool. This pool was then further amplified with unique dual indexes and sequenced on a MiSeq for >15,000 reads per sample.

B. Half of the treated pool was annealed to an appropriate 3'-barcoded adaptor (IDT) and treated with T4 DNA polymerase at 12° C. for 20 min to create a dsDNA pool. Using the conserved regions this pool was amplified with unique dual indexes (IDT) and sequenced on a MiSeq for >15,000 per samples.

Example 20—Lentivirus Production and Transduction

HEK293T cells were grown and passaged in Dulbecco's Modified Eagle's Medium plus GlutaMAX™ (gibco) supplemented with 10% (v/v) fetal bovine serum (gibco) at 37° C. with 5% $CO_2$. The day before transfection, cells were seeded at $5\times10^6$ per dish. The day of transfection, 8 g of PsPax, 1 μg of pMD2-G, and 9 μg of plasmid containing the cytidine deaminase fused with MG3-6 or Cas9 were mixed together and packaged into Mirus LT1 transfection reagent (Mirus Bio). The mixture was transfected into HEK293T cells. Lentiviruses were collected 3 days post-transfection, filtered through a 0.4 uM filter, and immediately used for transducing cells. Transduction occurs by adding ½ volume of virus containing supernatant to cells with 8 μg/mL of polybrene.

Figures 22A, 22B, 22C, 22D, 22E:
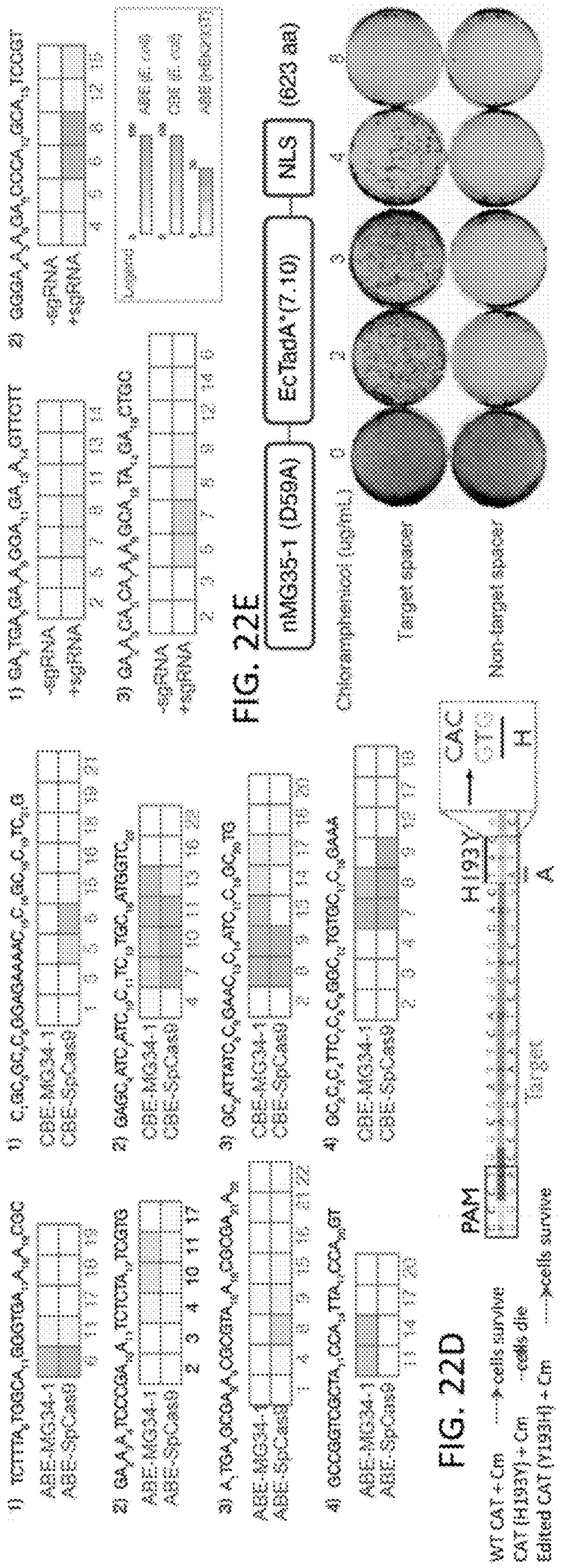
FIGS. 22A (SEQ ID NOs: 1800-1803), 22B (SEQ ID NOs: 1804-1807), 22C (SEQ ID NOs: 1808-1810), 22D (SEQ ID NOs: 1811-1813), and 22E show in vivo base editing with engineered MG34-1 and MG35-1 nickases. Panels (A) and (B) show base editing in the *E. coli* genome at four target loci.
FIG. 22B shows CBE-MG34-1 base editor vs. a reference CBE-SpCas9 (both with rAPOBEC1 deaminase and PBS1 UGI).
FIG. 22C shows base editing in human HEK293T cells with an ABE-MG34-1 nickase at three target loci. The target sequence for each locus in panels A, B, and C is shown above each heatmap. Expected edit positions are represented on the sequence by a subscript number and at each position on the heatmap (squares). Heatmaps in FIGS. 22 A, B, and C represent the percentage of NGS reads supporting an edit. Values in FIGS. 22 (A) and (B) represent the mean of two independent experiments, while values in panel (C) represent the mean of three independent biological replicates.
FIG. 22D shows an *E. coli* survival assay. *E. coli* is transformed with a plasmid containing the ABE, a non-functional chloramphenicol acetyltransferase (CAT H193Y) gene, and an sgRNA that either targets the CAT gene (target spacer) or not (non-target spacer). *E. coli* survival under chloramphenicol selection is dependent on the ABE base editing the non-functional CAT gene to its wild type sequence.
FIG. 22E, top panel shows a diagram of an ABE construct with an engineered MG35-1 nickase containing a C-terminal TadA*-(7.10) monomer and a SV40 NLS fused to the C-terminus.

Example 21—Adenine and Cytidine Base Editors in *E. coli* and Mammalian Cells To demonstrate that MG34-1, a small type II CRISPR nuclease, can be used as a base editor, a construct comprising TadA*(8.17m)-nMG34-1 (ABE-MG34-1, SEQ ID NO: 727), where TadA*(8.17m) is an engineered TadA from *E. coli*, and a construct comprising rAPOBEC1-nMG34-1-UGI (PBS) (CBE-MG34-1, SEQ ID NO: 739), where rAPOBEC1 is rat APOBEC1 and UGI (PBS) is the uracil glycosylase inhibitor of *Bacillus subtilis* bacteriophage, were generated. TadA*(8.17m)-nSpCas9 (SEQ ID NO: 728) and rAPOBEC1-nSpCas9-UGI (PBS) (SEQ ID NO: 740) were generated as positive controls for editing profile analysis. Four guides that target lacZ gene in *E. coli* (SEQ ID NOs: 729-736) were designed and prepared for each base editor construct. Plasmids were transformed into BL21 (DE3), recovered in recovery media at 37° C. for 1 h, and cell plates were plated on LB agar plates containing 100 μg/mL carbenicillin and 0.1 mM IPTG. After growing cells at 37° C. for 16 to 20 h, colony PCR was used to amplify the targeted regions in *E. coli* genome, and the resulting products were analyzed with Sanger sequencing at Elim BIOPHARM (FIGS. 22A-22C). Sequencing results indicated that both ABE-MG34-1 and CBE-MG34-1 edited target loci in the *E. coli* genome at levels and within editing windows comparable to the positive control SpCas9 base editors (FIGS. 22A and 22B). Further, TadA*(8.17m)-nMG34-1 showed higher base substitution on two targeted loci. ABE-MG34-1 also displayed base editing in human cells with up to 22% editing efficiency across three different genomic targets (FIG. 22C).

To determine whether the SMART HNH endonuclease-associated RNA and ORF (HEARO) enzymes can be used as base editors, an ABE was constructed by fusing a TadA*-(7.10) deaminase monomer to the C-terminus of an engineered MG35-1 containing a D59A mutation (FIG. 22E). The A to G editing of this ABE was tested in a positive selection single-plasmid *E. coli* system in which the ABE is required to revert a chloramphenicol acetyltransferase (CAT) gene containing a Y193 mutation back to H193 to survive chloramphenicol selection (FIG. 22D). This plasmid contains a sgRNA with a spacer either targeting the mutant CAT gene or a scrambled, non-targeting spacer region (control). An enrichment of colonies was detected with *E. coli* transformed with the ABE-MG35-1 targeting the CAT gene when grown on plates containing 2, 3, and 4 μg/mL of chloramphenicol, while no colonies grew on the plate containing 8 μg/mL of chloramphenicol (FIG. 22E). Sanger sequencing confirmed that 26 of 30 colonies picked from the 2, 3, and 4 μg/mL plates transformed with the target spacer contained the expected Y193H reversion (Table 11 and FIG. 31).

TABLE 11

| E. coli survival assay with ABE-MG35-1 | | |
|---|---|---|
| Chloramphenicol | Edited colonies | |
| (ug/mL) | Target spacer | Non-target spacer |
| 0 | 1/10 | 0/10 |
| 2-4 | 26/30 | No colonies |
| 8 | No colonies | No colonies |

Colonies grown on plates containing chloramphenicol concentrations of 0, 2, 3, and 4 μg/mL were sequenced to confirm reversion of the CAT gene function. Experiments were performed as n = 2.

It is understood that the four colonies without the reverted CAT sequence contain more unedited than edited copies of the selection construct, as a single reverted CAT gene is sufficient to confer colony survival. No colonies were seen on the 2, 3, 4, and 8 μg/mL plates for *E. coli* cells transformed with the non-targeting spacer. While the 0 μg/mL condition was used as a transformation control, 1 of 10 colonies picked from the 0 μg/mL plate for cells transformed with the targeting spacer contained the Y193H reversion, indicating a detectable level of editing without chloramphenicol selection. However, the colony growth enrichment under chloramphenicol selection for the targeting ABE-MG35-1 condition confirmed that the MG35-1 nickase is a successful component for base editing. At 623 aa long, the ABE-MG35-1 represents the smallest, nickase-based adenine base editor to date (Table 12).

TABLE 12

| Size comparison of SMART nucleases vs. references | | | |
|---|---|---|---|
| Enzyme | Length (aa) | ABE length* (aa) | CBE length (aa) |
| MG34-1 | 748 | 969 | 1104 |
| MG35-1 | 429 | 623 | — |
| SpCas9 | 1376 | 1588 | 1723 |
| CasMINI (type V) | 529 | — | — |

Base editor (ABE and CBE) size is approximated based on linkers and number of NLS signals added.
*For ABE, size was estimated with one TadA monomer.

Example 22—Adenine Base Editor in Mammalian Cells

Figure 21:
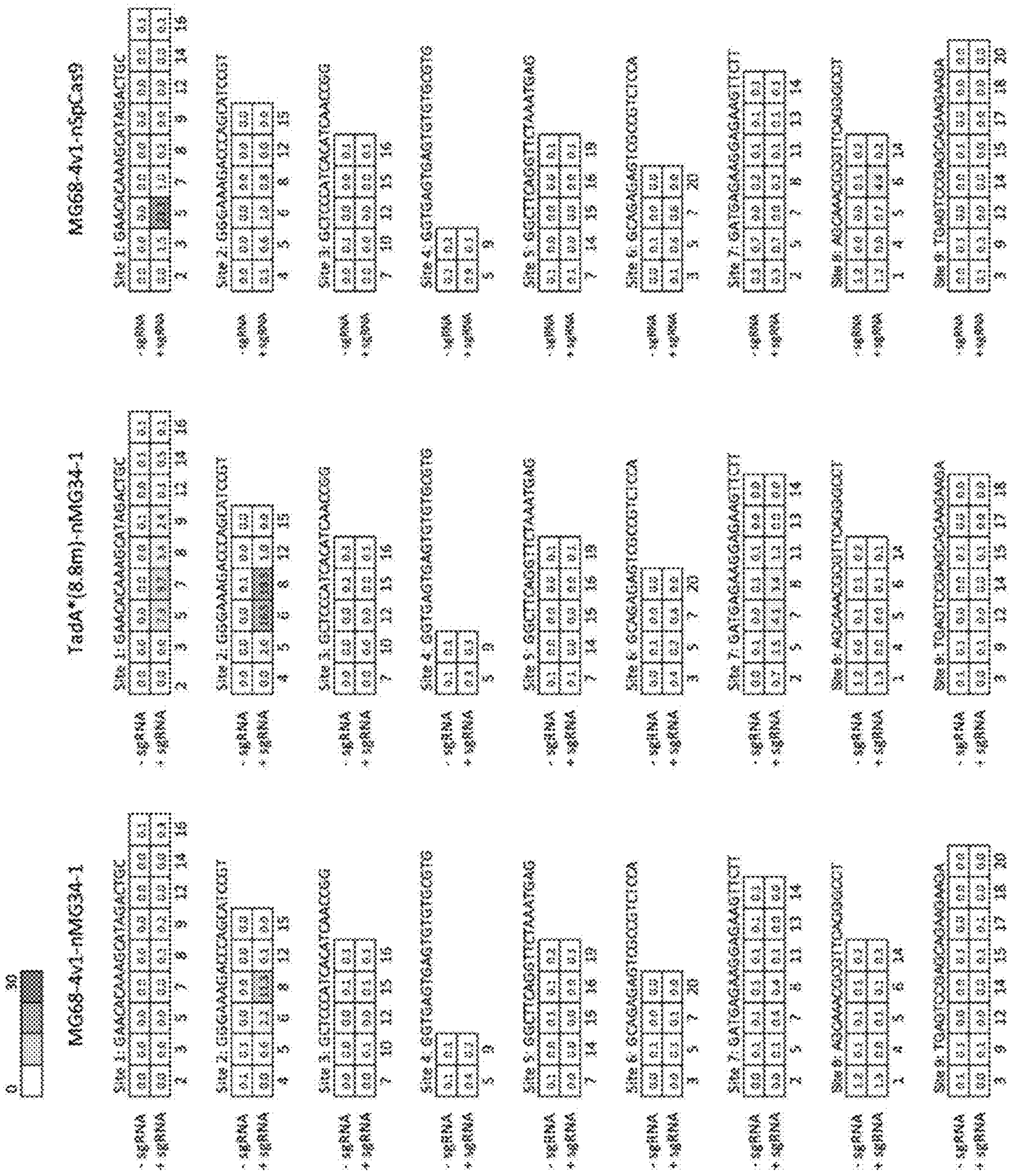
FIG. 21 (SEQ ID NOs: 1791-1799) shows a diagram illustrating base editing efficiencies of adenine base editors at specific nucleotide sites using MG68-4v1 fusing with either nMG34-1 or nSpCas9. 9 guides were designed to target genomic loci of HEK293T cells. Abbreviations: MG68-4v1, MG68-4 (D109N); nMG34-1, MG34-1 nickase; nSpCas9, SpCas9 nickase.

In a previous experiment, MG68-4v1 (predicted as a tRNA adenosine deaminase) was able to convert adenine to guanine, resulting in bacterial survival under chloramphenicol selection. Next, two base editors fusing deaminase with nickase, MG68-4v1-nMG34-1 and MG68-4v1-nSpCas9 were constructed. As a positive control for deaminase activity, an active variant engineered by Gaudelli et al. and created TadA*(8.8m)-nMG34-1 was used. To ensure genomic loci are able to be accessed by base editors, we selected guides that have shown activity for SpCas9 in mammalian cells. Out of 9 sites tested, MG68-4v1-nMG34-1 showed 11.3% editing efficiency at position 8 of site 2. When MG68-4v1 was fused to nSpCas9, the base editor exhibited 22.3% efficiency at position 5 of site 1 and 4.4% efficiency at position 6 of site 8. The replacement of MG68-4v1 with TadA*(8.8m) in MG68-4v1-nMG34-1 showed 7.3% and 9.7% at position 5 and 7 of site 1, respectively. The efficiencies were increased to 16.5% and 19.5% at position 6 and 8 of site 2, respectively. Besides, 4.1% and 3.4% editing were observed at position 7 and 8 when targeting to site 7. Taken together, these results indicate that MG68-4v1 and nMG34-1 demonstrate base editing activity in mammalian cells (FIG. 21).

Example 23—Activity in Mammalian Cells (Cytidine Deaminase Assay in Tissue Culture Cells) (Prophetic)

The cytidine deaminase assay in cells is designed so that when the mutated stop codon ACG is mutated to ATG by a cytidine deaminase, cells can translate the blasticidin gene and therefore acquire resistance to this antibiotic. Upon transducing a reporter cell line (ACG containing cell) with a library of cytidine deaminases fused to Cas9 or MG3-6, it is expected that a fraction of cells will mutate the ACG to ATG and therefore gain resistance to blasticidin. Cells that have acquired such resistance and thus survive the selection assay are later subjected to next generation sequencing (NGS) to unveil the identity of the successful cytidine deaminase displaying cytidine base editor activity.

Example 24—Mammalian Constructs for Cytosine Base Editors (CBEs)

Plasmids for CBEs using the nickase forms of spCas9, MG3-6, and MG34-1 were constructed using NEB HiFi assembly mix and DNA fragments containing the novel cytidine deaminases, the nuclease enzymes, and UNG sequence. For constructs containing spCas9, pAL318 was digested with the NotI and XmaI restriction enzymes. For constructs containing MG3-6, pAL320 was digested with the NcoI restriction enzyme. For constructs containing MG34-1, pAL226 was digested with the NotI and BamHI restriction enzymes.

For experiments targeting the engineered cell line (SEQ ID NO. 962), CDAs were fused with MG3-6 nickase. For cloning CDA constructs in the MG3-6 nickase backbone, CDAs were ordered as gene fragments from Twist and digested with SphI and BmtI. The plasmid backbone containing MG3-6 was digested with SphI and BmtI, and the gene fragments were ligated using T4 DNA ligase. The plasmid backbone contains a mU6 promoter for cloning gRNAs targeting the engineered sites. The spacers targeting the engineered sites using MG3-6 are shown in SEQ ID NOs. 963-967.

Figures 1, 25A:
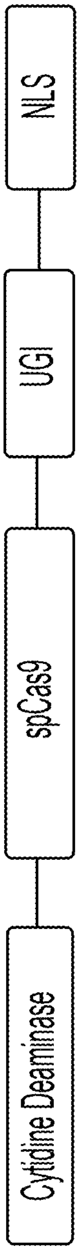
FIGS. 25A (SEQ ID NOs: 496 and 518-521), 25B (SEQ ID NOs: 505-509), and 25C (SEQ ID NOs: 861-863, 1798, and 865), depict data demonstrating that Cytosine Base Editors (CBEs) containing novel cytidine deaminases with spCas9, MG3-6, or MG34-1 effectors show varying editing levels in HEK293 cells. Each novel cytidine deaminase is fused via a linker to the N-terminus of the effector (spCas9, MG3-6, or MG34-1). A uracil glycosylase inhibitor domain (UGI or MG69-1) is fused to the C-terminus of the effector, followed by a Nuclear Localization Signal (NLS). Each CBE was transiently transfected into HEK293 cells and targeted to 5 distinct genomic locations with corresponding sgRNAs (spacer sequence indicated, targeted cytosines underlined). Editing levels (C to T (%)) of spacer sequence and surrounding cytosines are indicated for CBEs with each distinct cytidine deaminase effector (n=3).
Figures 2, 25A:
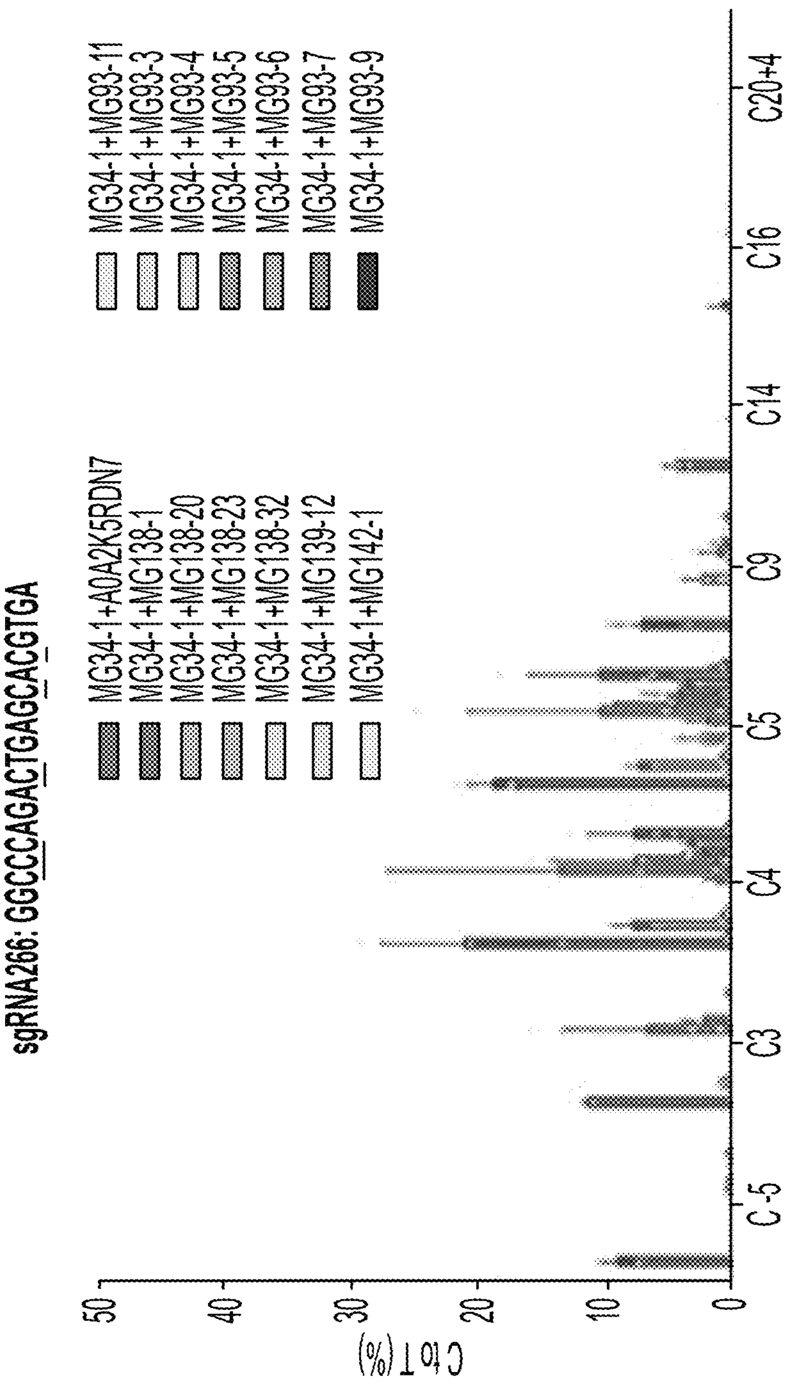
Figures 3, 25A:
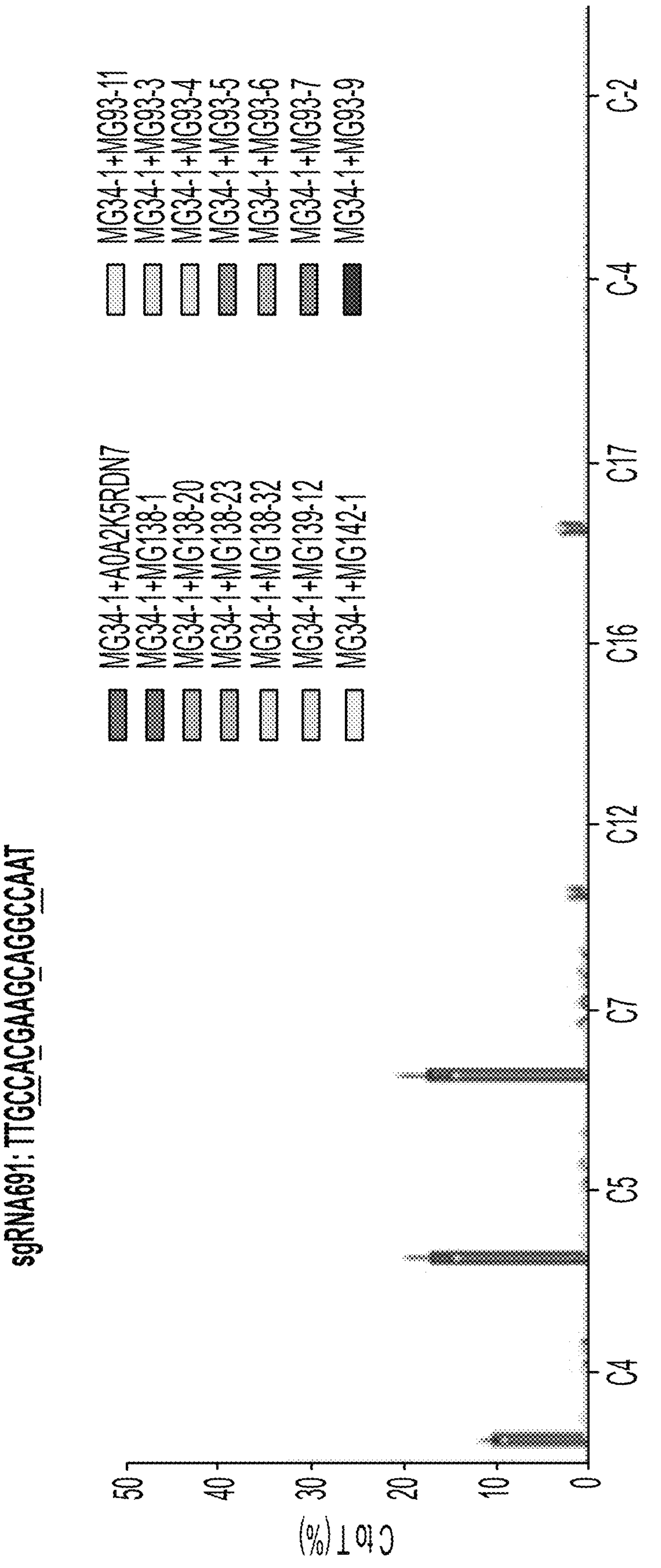
Figures 4, 25A:
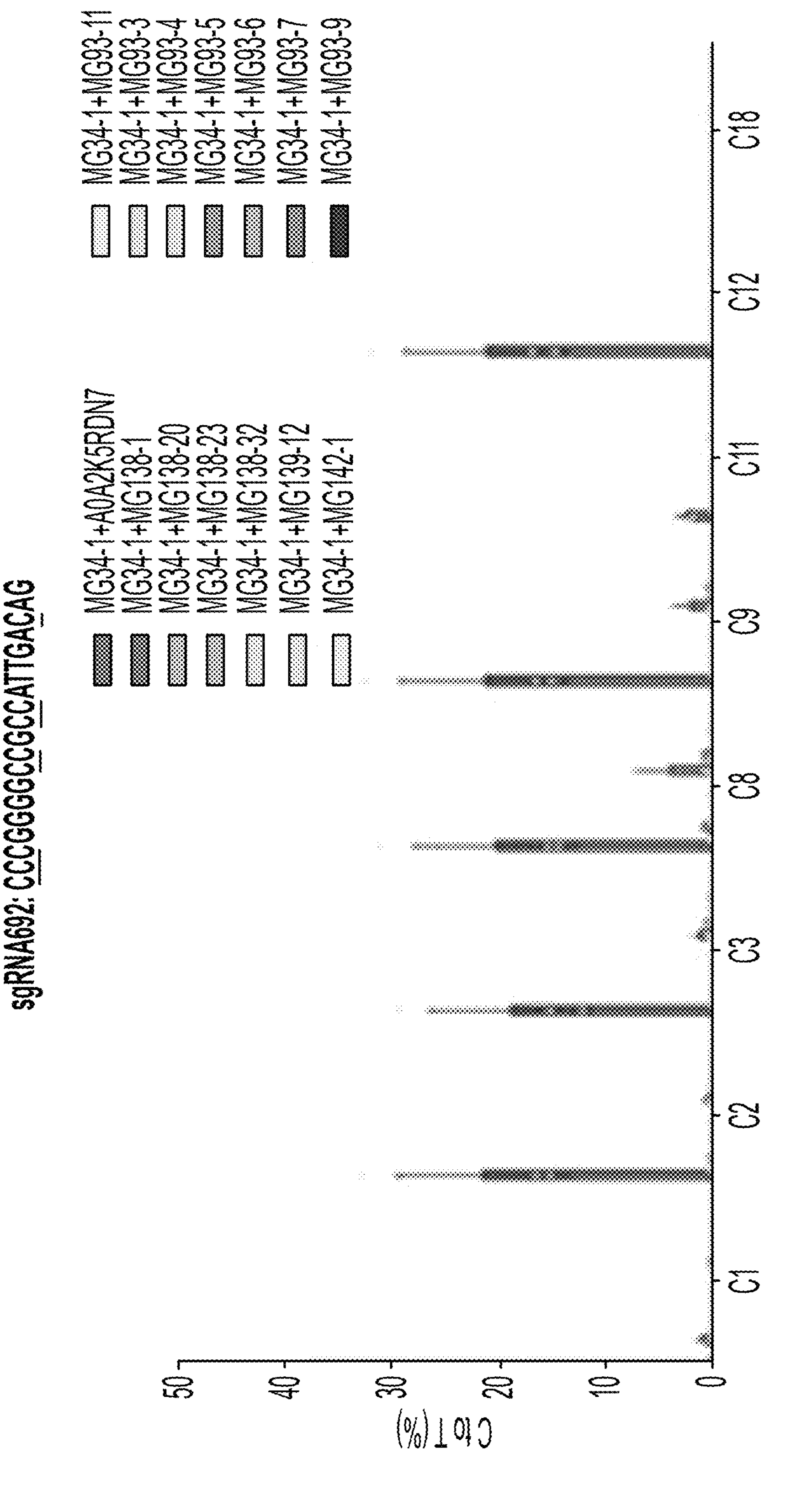
Figures 5, 25A:
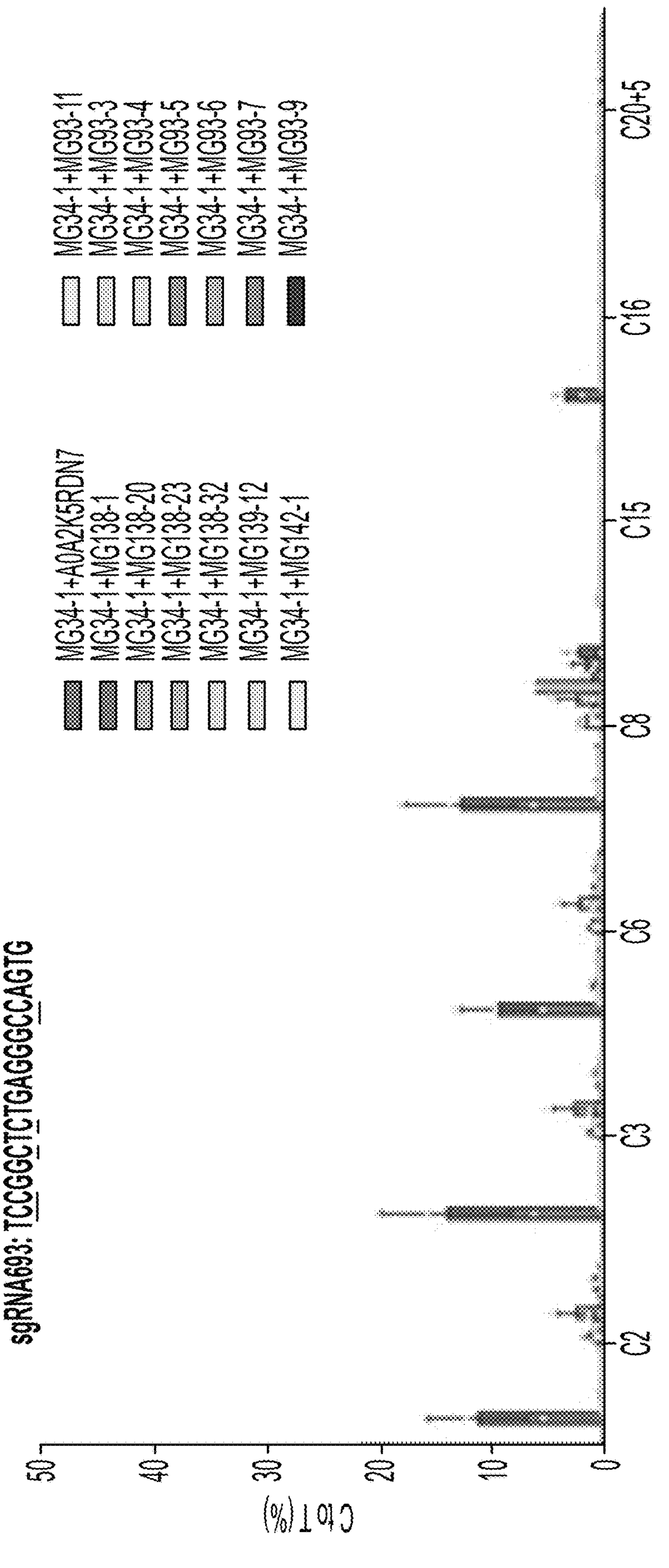
Figures 6, 25A:
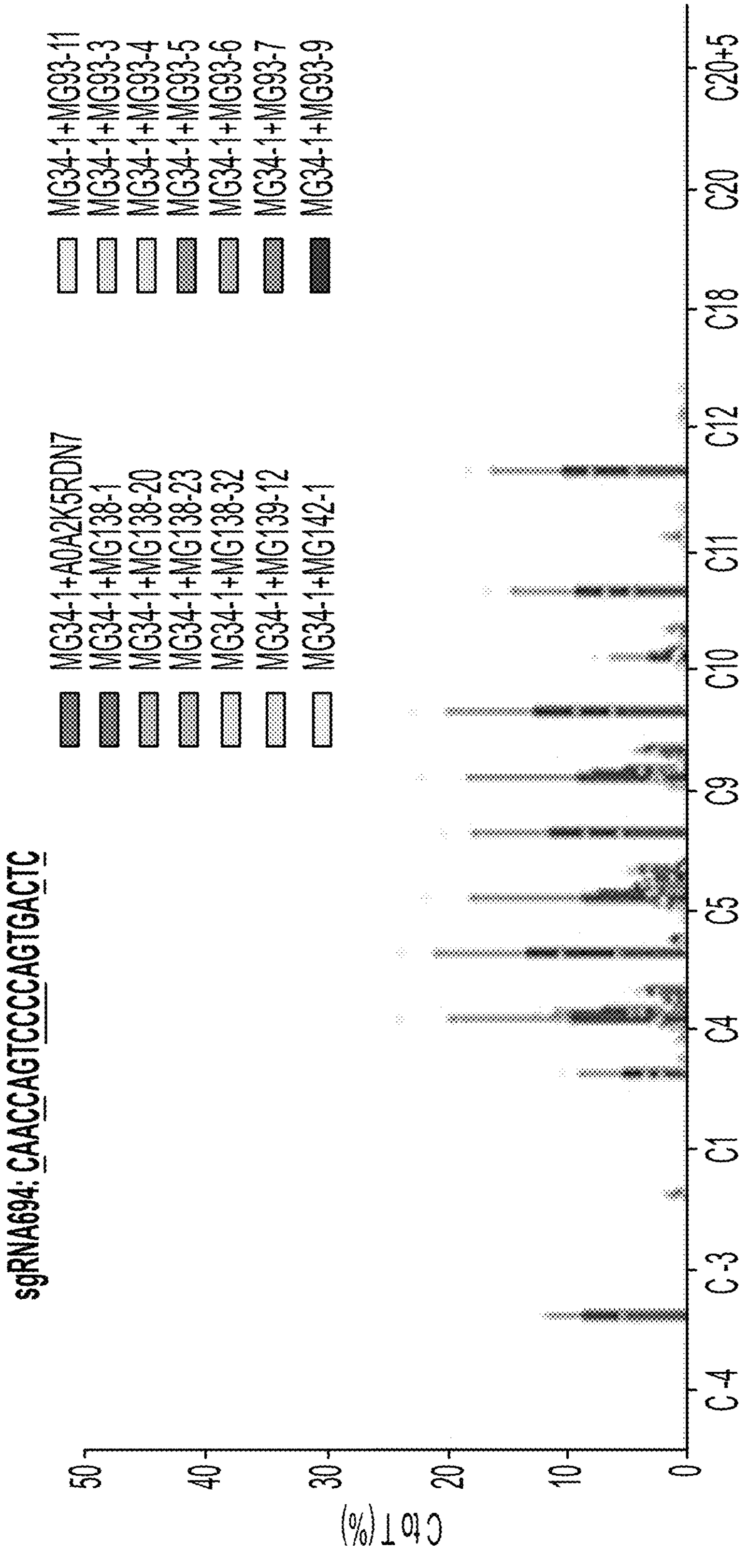
Figures 1, 25B:
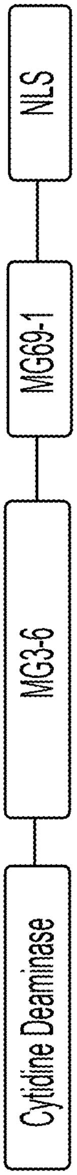
Figures 2, 25B:
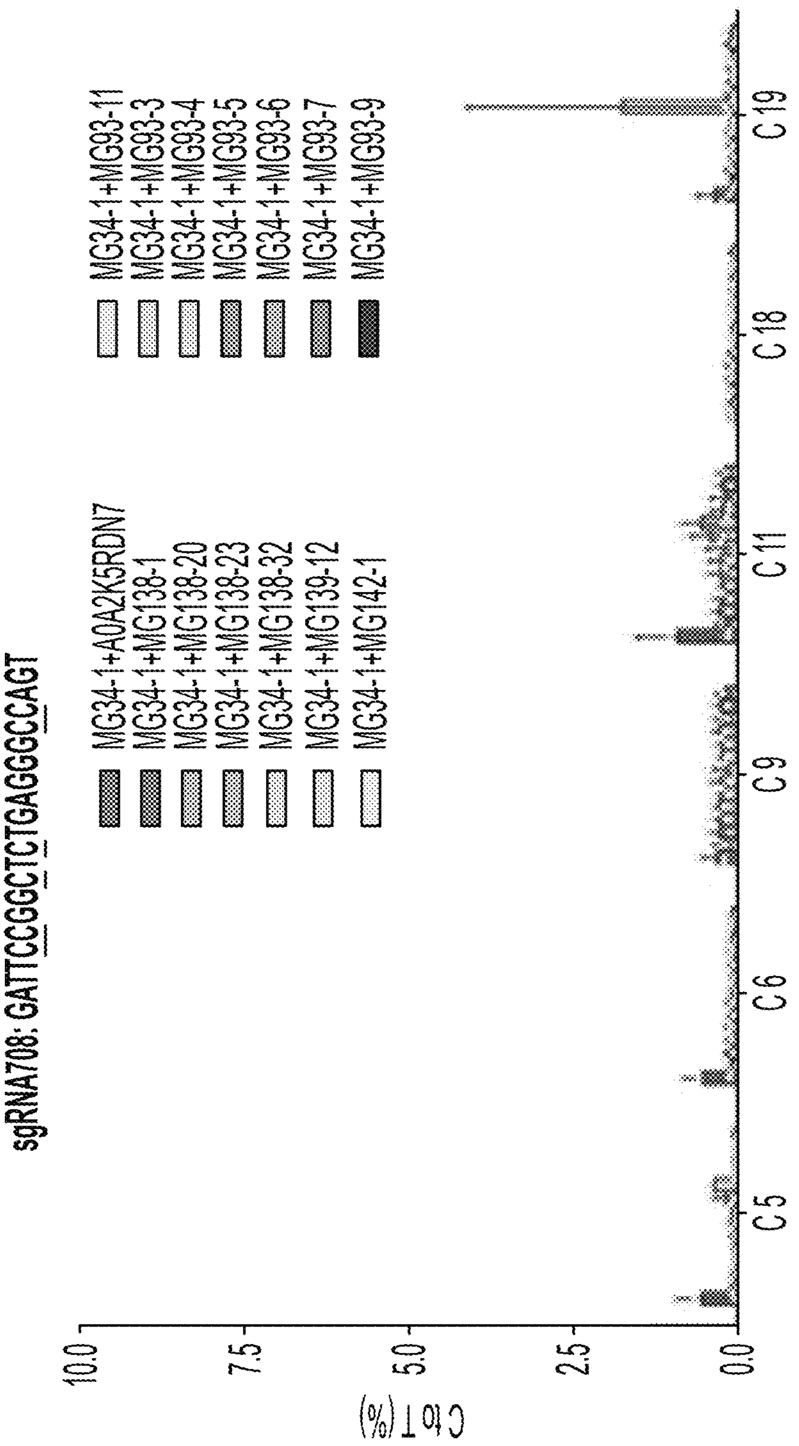
Figures 3, 25B:
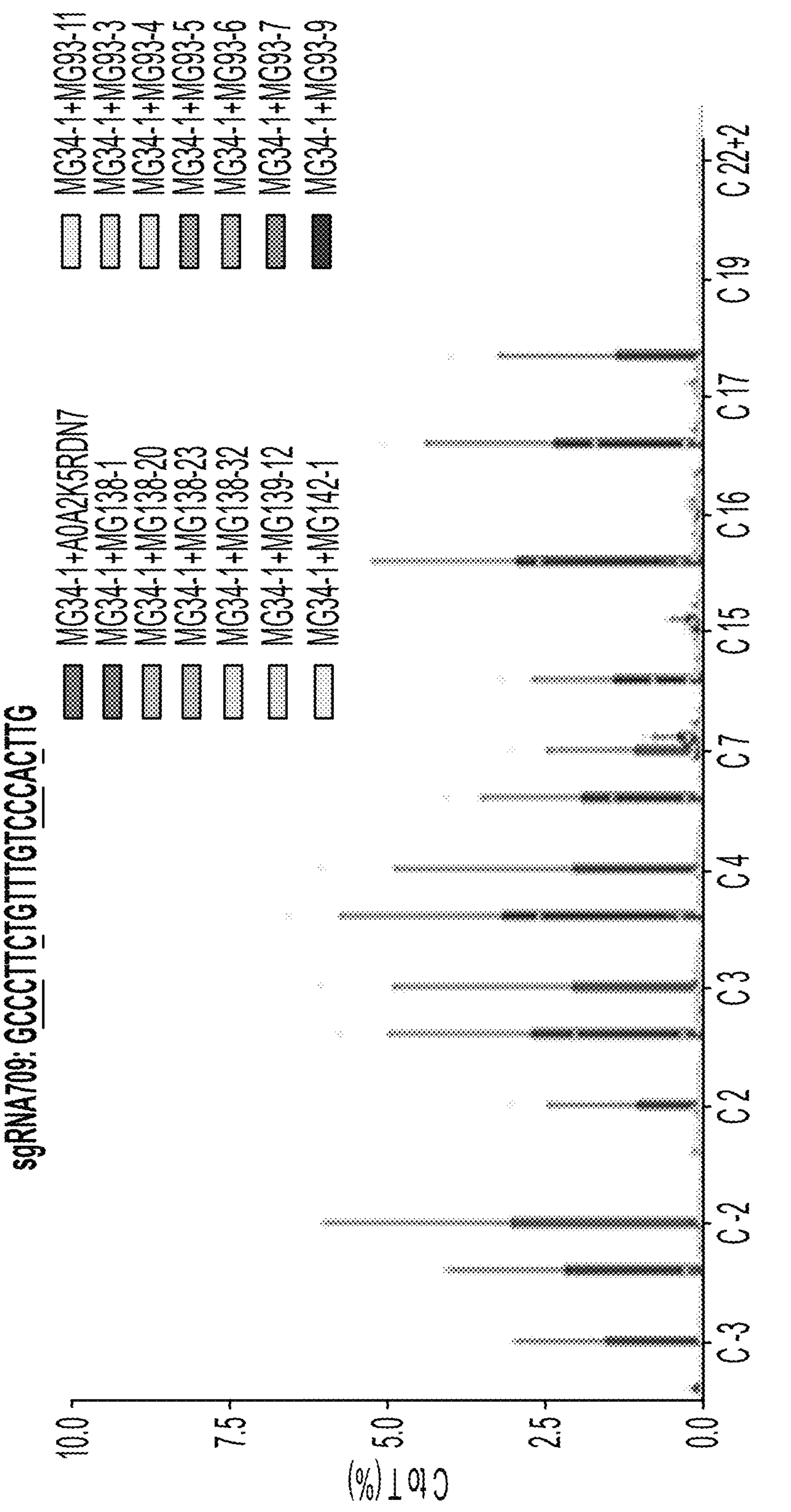
Figures 4, 25B:
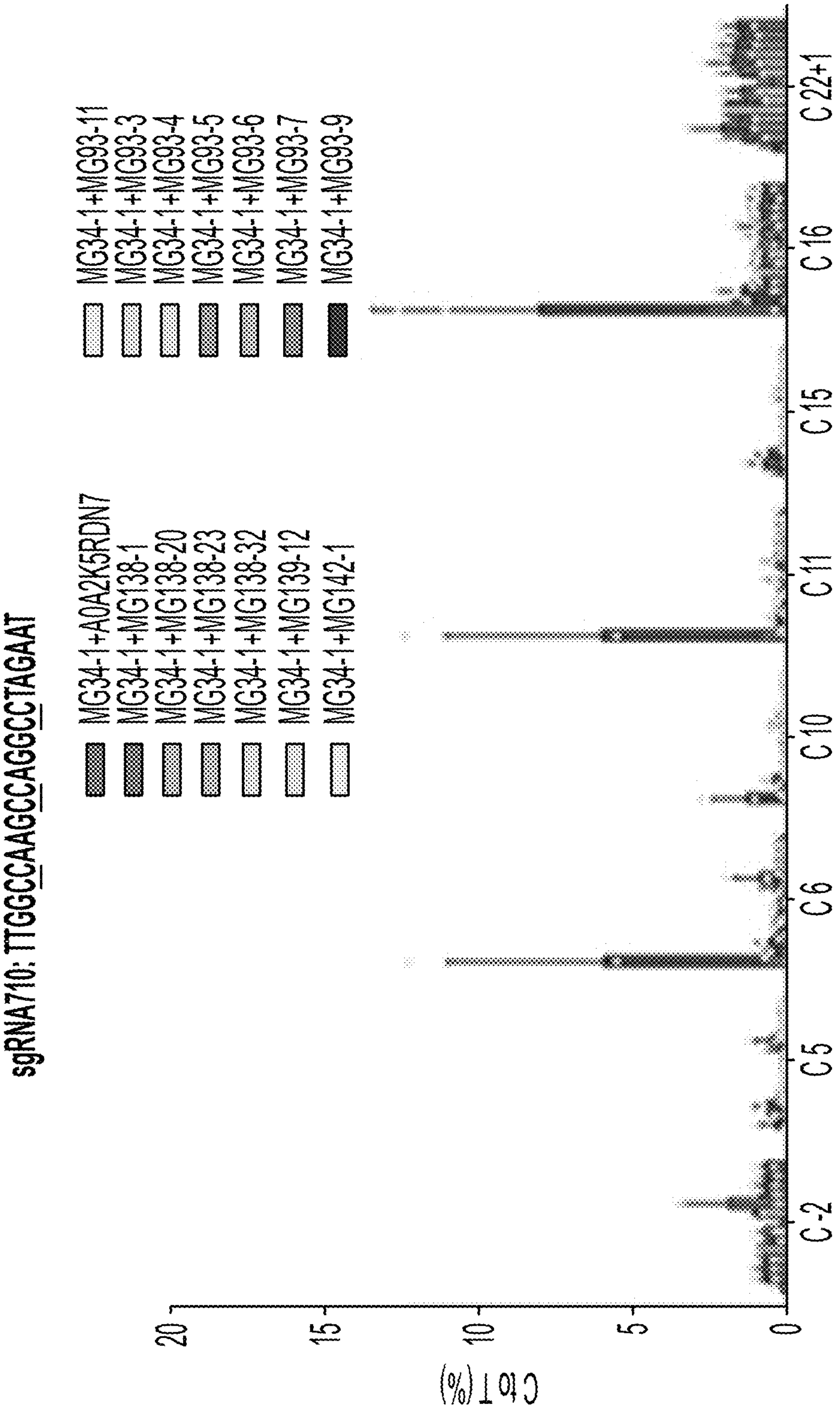
Figures 5, 25B:
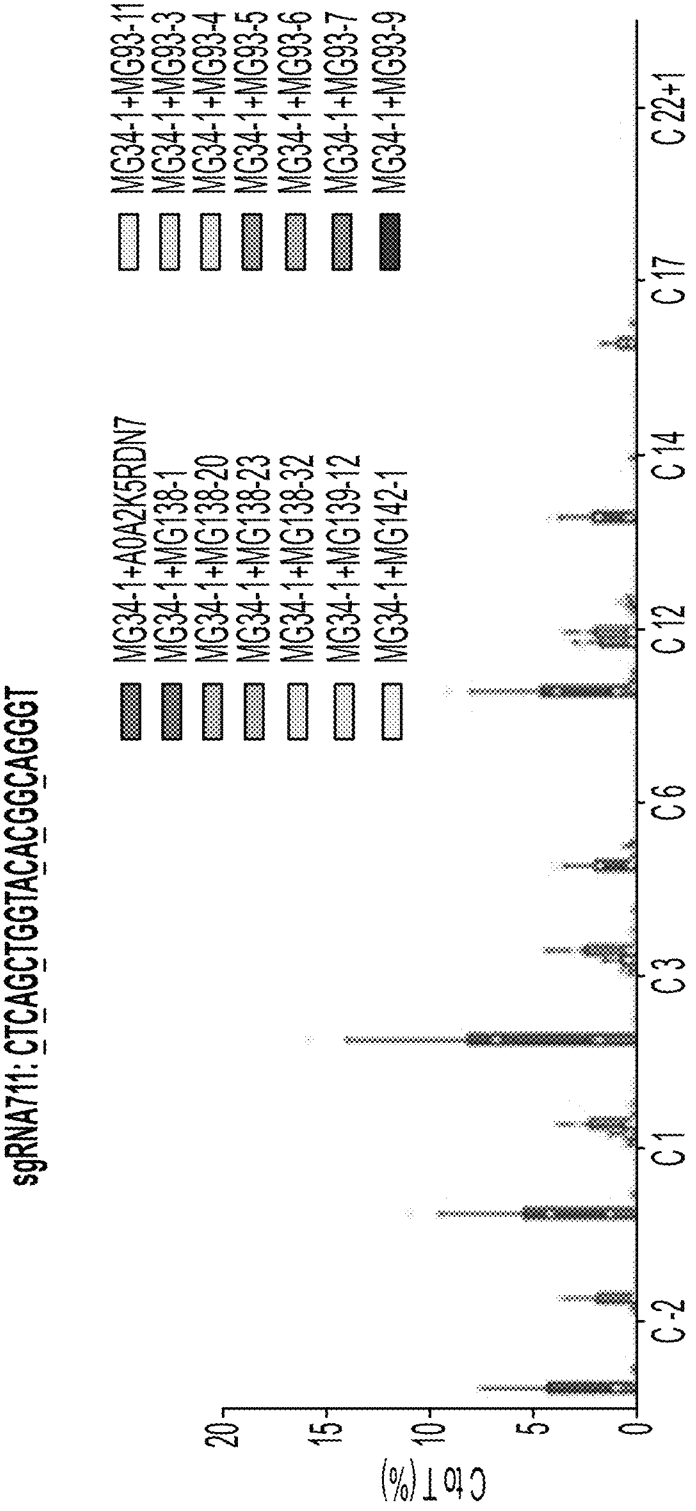
Figures 6, 25B:
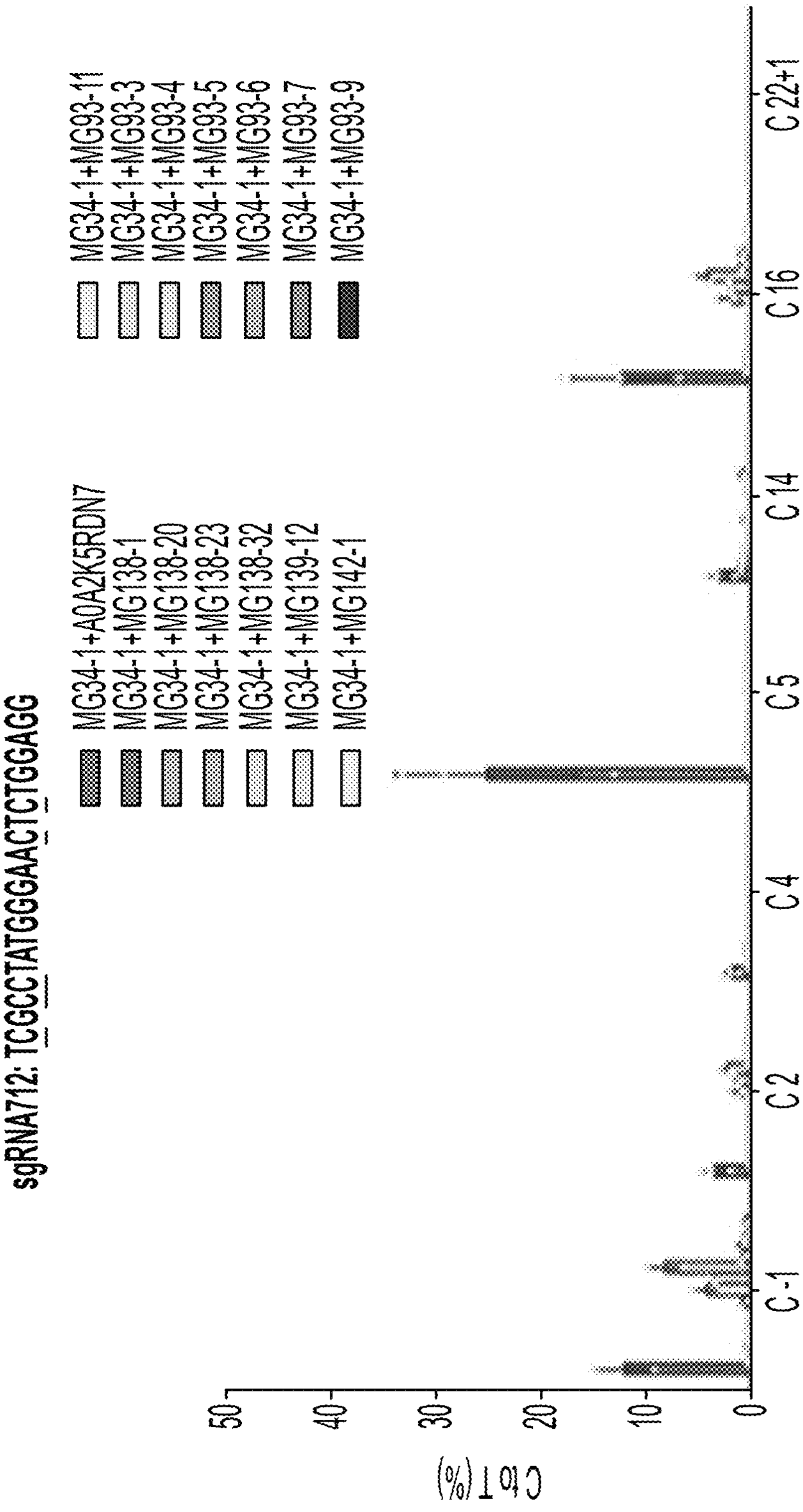
FIGS. 6A (SEQ ID NOs: 1668-1703) and 6B (SEQ ID NOs: 1704-1739) show sgRNA designs for lacZ targeting in *E. coli*. The spacer length used for the systems described herein was 22 nucleotides. For selected systems described herein, three sgRNAs targeting lacZ in *E. coli* were designed to determine editing windows.
Figures 1, 25C:
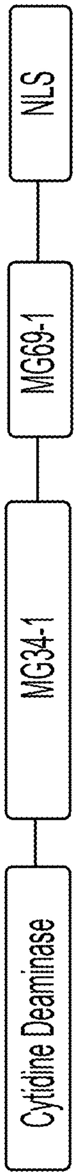
Figures 2, 25C:
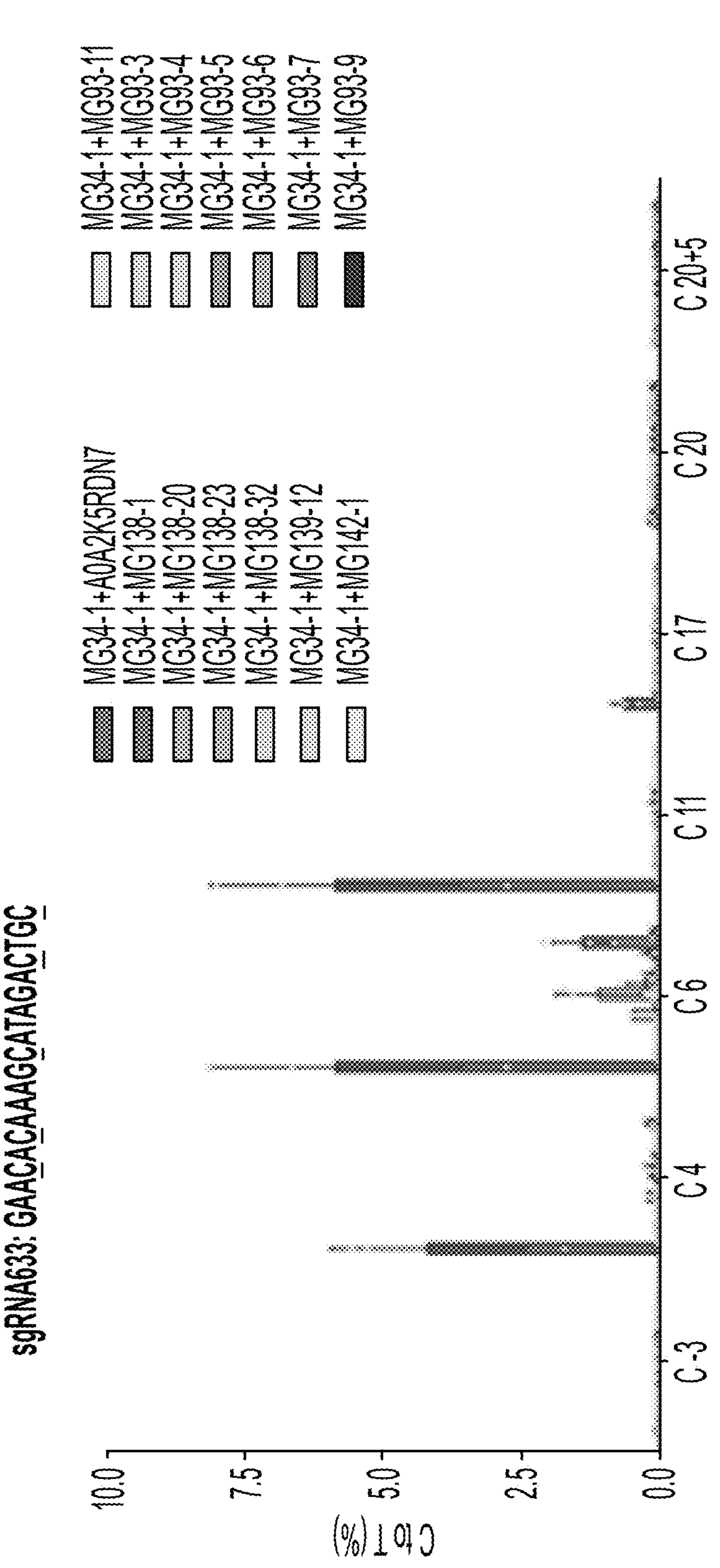
Figures 3, 25C:
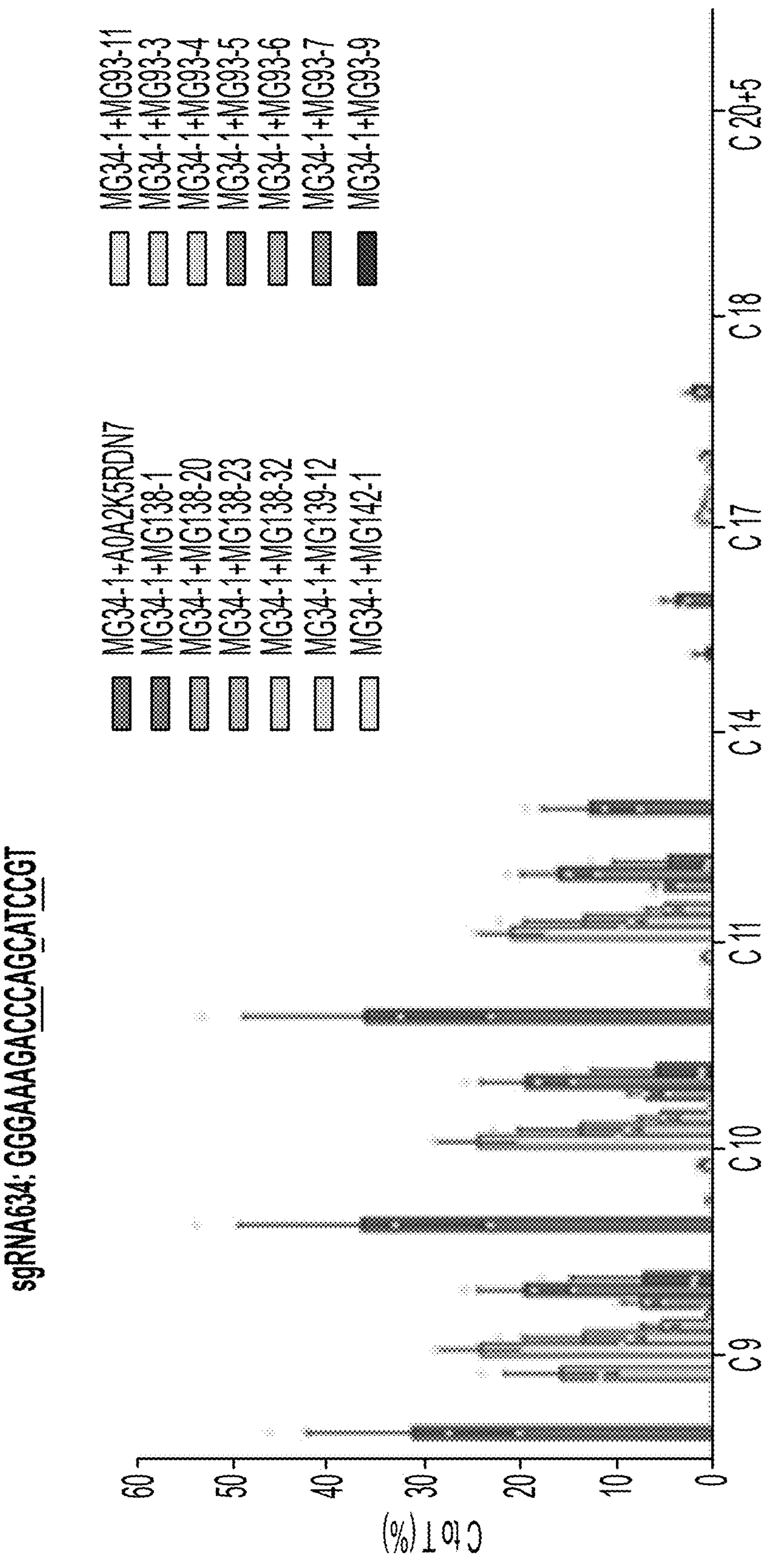
Figures 4, 25C:
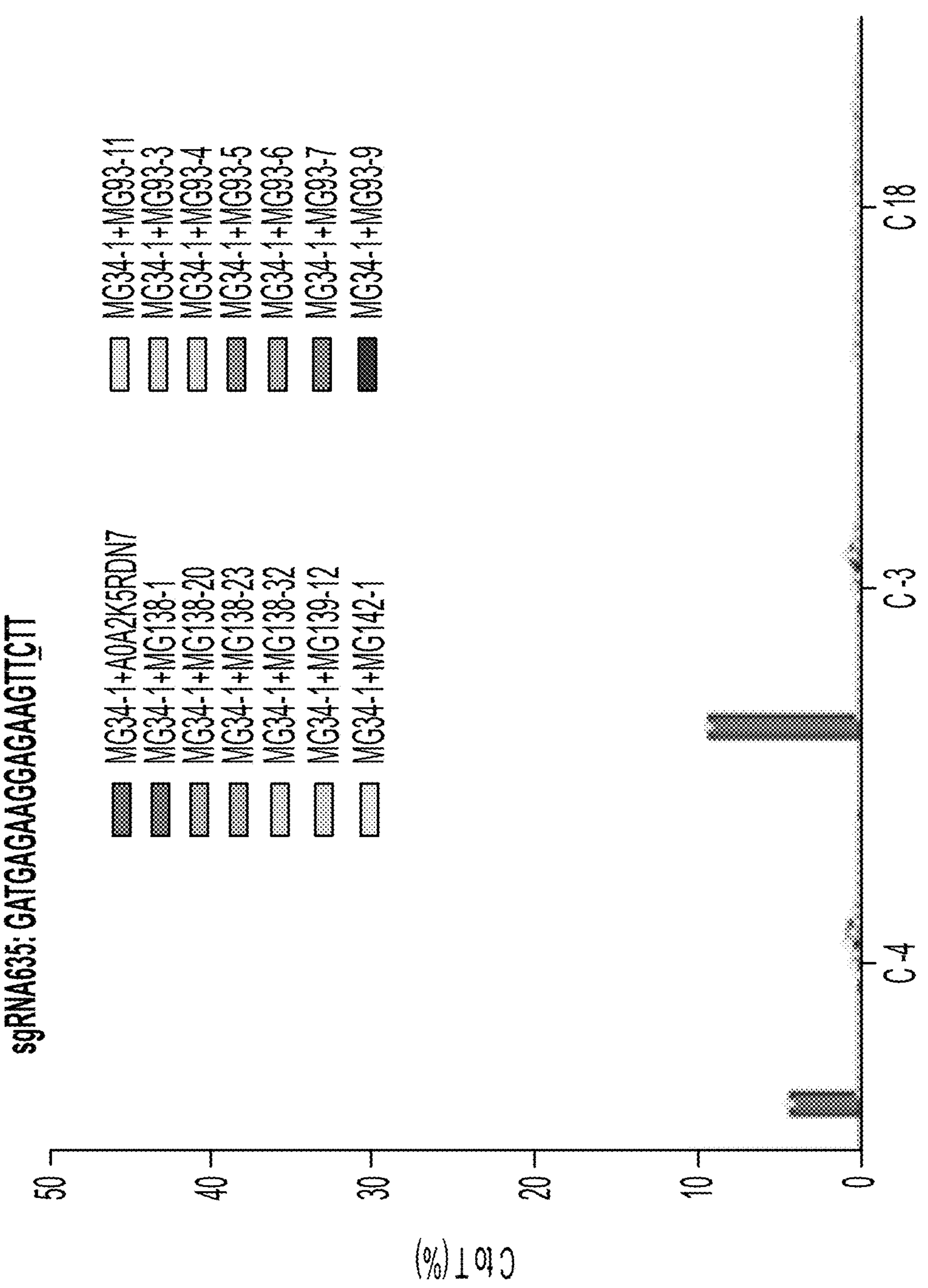
Figures 5, 25C:
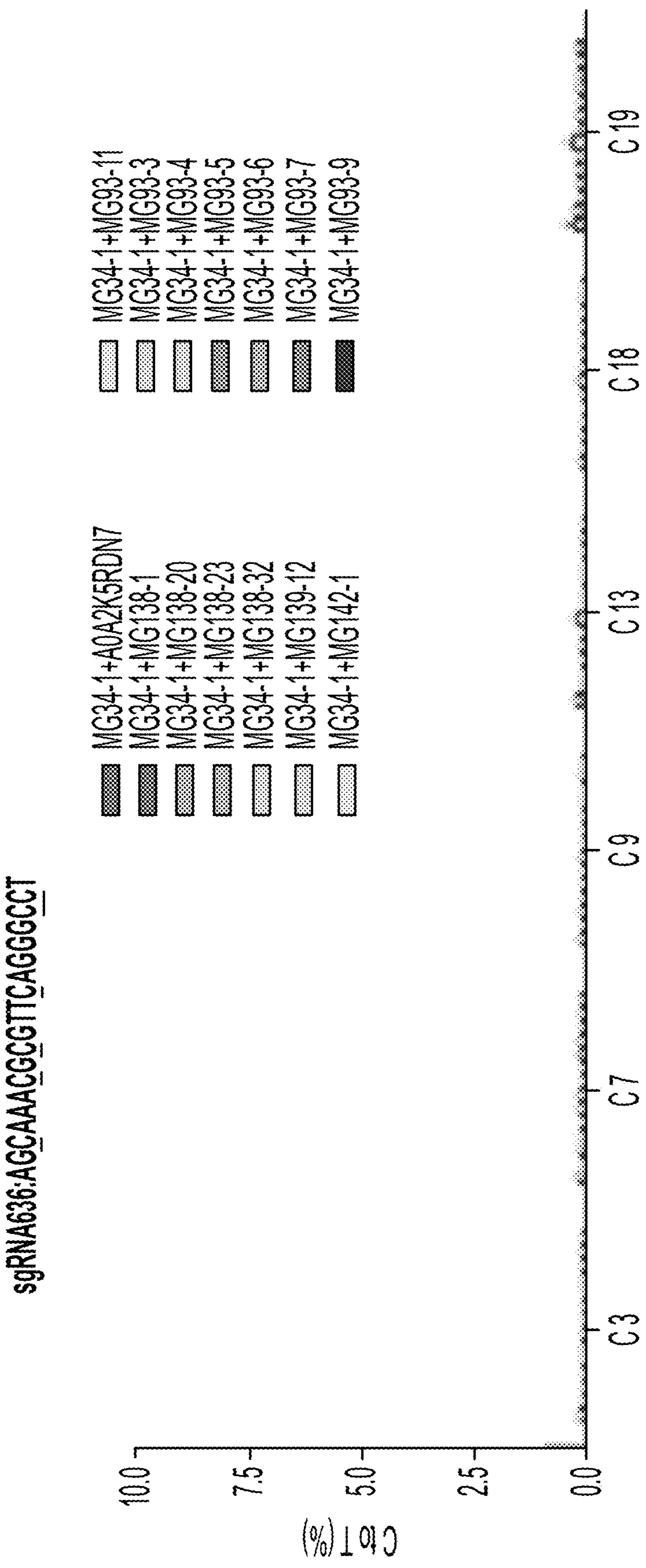
Figures 6, 25C:
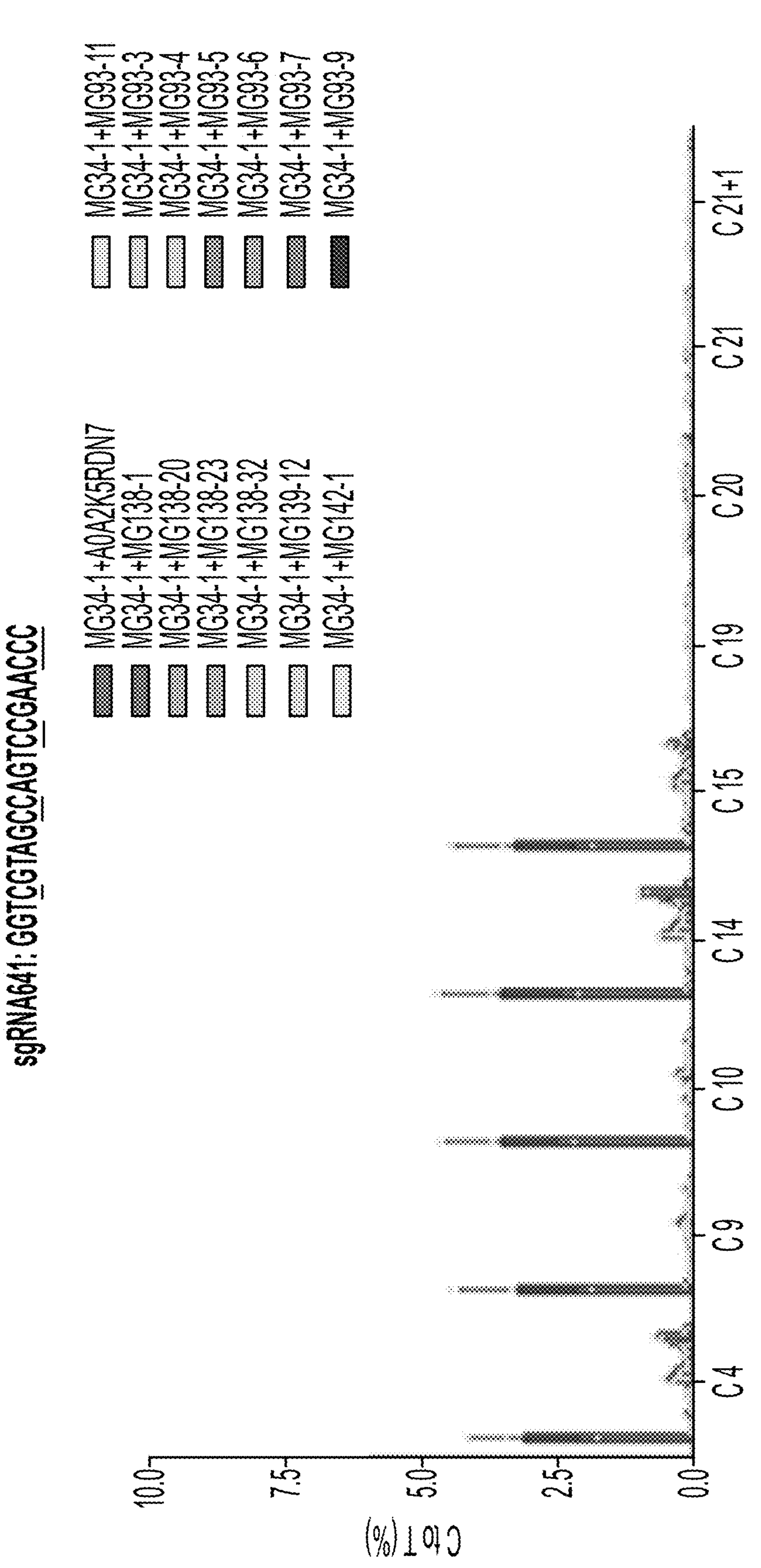

CBEs were constructed using various combinations of cytidine deaminases, nickase effectors, and uracil glycosylase inhibitors (FIGS. 25A-25C). Overall, 14 cytidine deaminases (13 novel cytidine deaminases (MG139-12 (SEQ ID NO. 970), MG93-3 (SEQ ID NO. 971), MG93-4 (SEQ ID NO. 972), MG93-5 (SEQ ID NO. 973), MG93-6 (SEQ ID NO. 974), MG93-7 (SEQ ID NO. 975), MG93-9 (SEQ ID NO. 976), MG93-11 (SEQ ID NO. 977), MG138-17 (SEQ ID NO. 978), MG138-20 (SEQ ID NO. 979), MG138-23 (SEQ ID NO. 980), MG138-32 (SEQ ID NO. 981), and MG142-1 (SEQ ID NO. 982)) that were shown to be active in vitro and the A0A2K5RDN7 cytidine deaminase were each fused with 3 effectors (spCas9 (SEQ ID NOs. 877-889 and 968), MG3-6 (SEQ ID NOs. 890-902 and 969), or MG34-1 (SEQ ID NOs. 903-916)) to generate 42 distinct CBEs. Fusions containing spCas9 were fused with a C-terminal UGI, and fusions containing MG3-6 or MG34-1 were fused with a C-terminal MG69-1 UGI. Each CBE was tested with 5 sgRNAs (spCas9 (SEQ ID NOs. 917-921), MG3-6 (SEQ ID NOs. 922-926), or MG34-1 (SEQ ID NOs. 927-931)) targeting the HEK293 genome. Editing levels (C to T (%)) are shown for all cytosines within 5 bp of the spacer region. Numerous CBEs showed detectable editing levels when transiently transfected into HEK293 cells. When fused to spCas9, both MG93-4 and MG138-20 exceeded 5% editing at certain sites with MG93-3, MG93-7, and A0A2K5RDN7 exceeding 10% editing. When fused to MG3-6, MG93-4 and A0A2K5RDN7 exceeded 5% editing at certain sites. When fused to MG34-1, MG93-4, MG93-6, and MG93-9 exceeded 5% editing at certain sites, MG93-3, MG93-7, and MG139-12 exceeded 10% editing, and MG93-11 and A0A2K5RDN7 exceeded 20% editing. Numerous novel cytidine deaminases have been identified that are compatible with spCas9, MG3-6, and MG34-1 and are able to deaminate cytosines in mammalian cells.

Figure 26A:
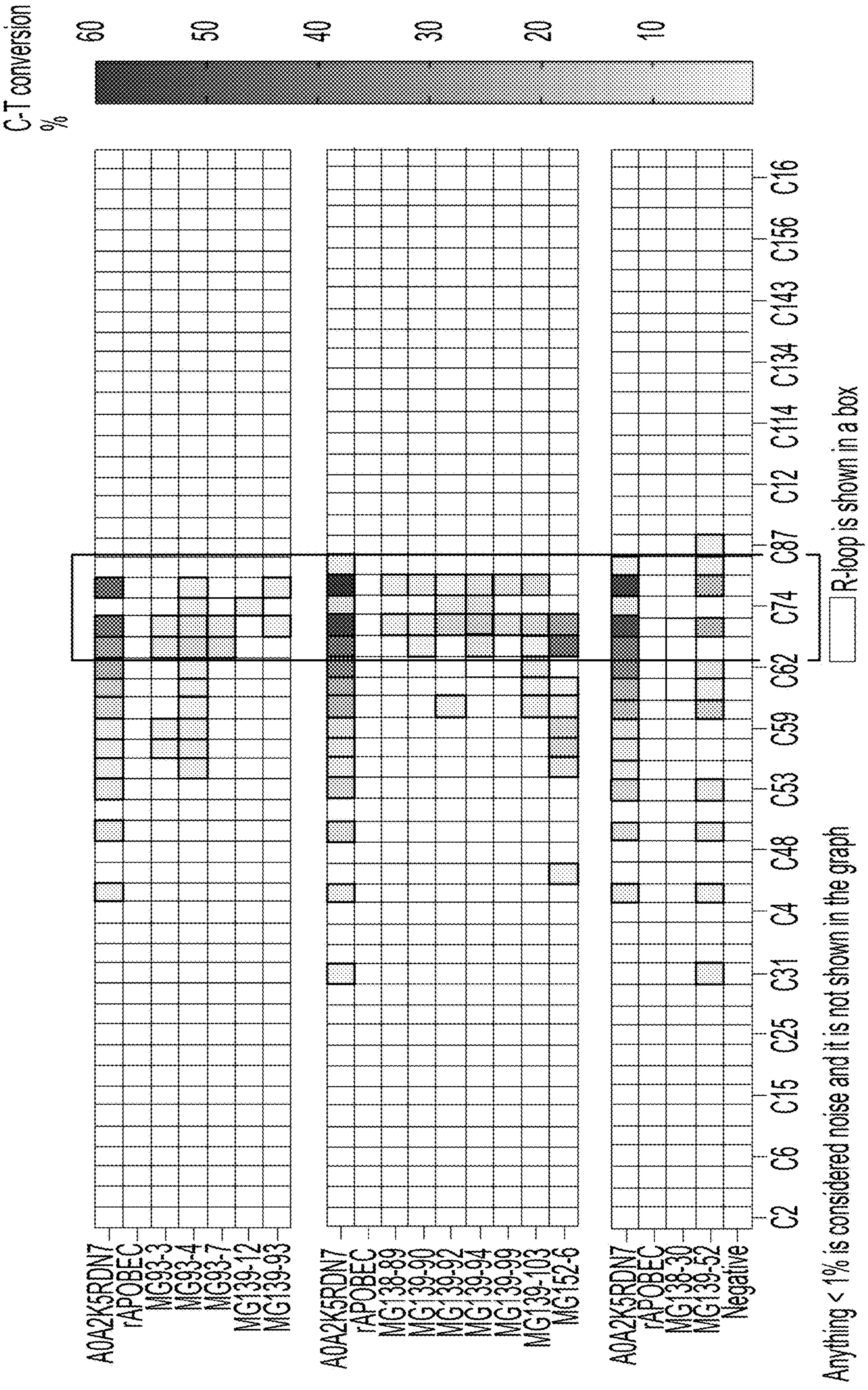
FIGS. 26A, 26B, and 26C (SEQ ID NOs: 1817, 1878, 1817 and 1879) depicts the activity of cytidine deaminases (CDAs) fused to MG3-6. Cytidine deaminases were fused to MG3-6 and their activity was assessed by targeting an engineered site in a reporter cell line.
Figure 26B:
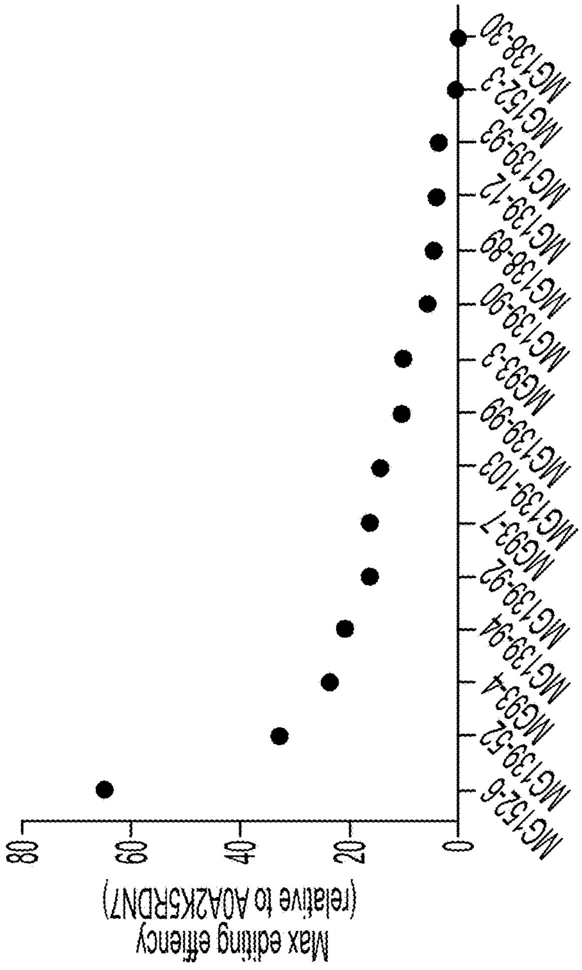
Figure 26C:
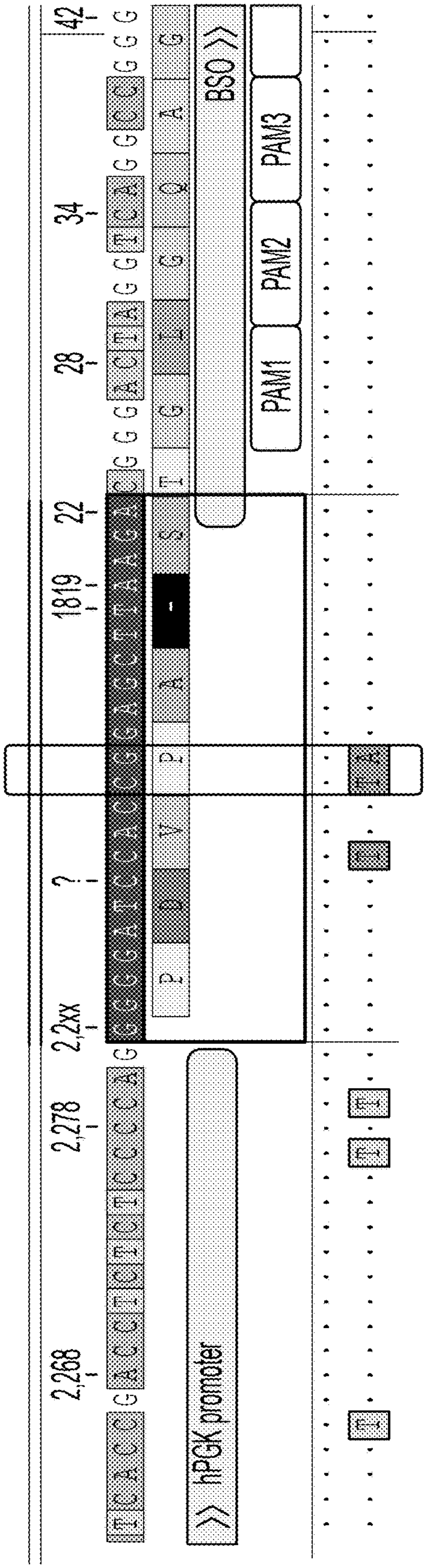

In order to test the novel CDAs and assay for −1 nucleotide preferences, the CDAs were fused to MG3-6 and targeted a reporter cell line with 5 engineered PAMs in tandem (sequence ID no. 962). 14 CDAs were tested using this system, and many show >1% editing (Panel (a) of FIG. 26). The highest activity observed for a novel CDA fused to MG3-6 was 38.4% for MG152-6, with the second highest showing 17.6% for MG139-52. Their relative activity in comparison to A0A2K5RDN7 is shown in Panel (b) of FIG. 26. Interestingly, it was also observed that the highly active MG139-52 might deaminate the DNA strand that is part of the DNA/RNA heteroduplex in the R-loop (as well as the ssDNA); an example of this is shown in Panel (c) of FIG. 26. This activity (DNA deamination when the DNA is in a DNA/RNA heteroduplex) may highly improve off target effects as well as editing window, both of which may be beneficial for cytotoxicity.

Example 25—Cytosine Base Editors Toxicity in Mammalian Cells

HEK293T cells were transduced with lentiviruses carrying newly discovered CDAs fused to MG3-6. Successful transformants were selected by using 2 μg/mL of puromycin for 3 days. Death cells were washed with PBS and surviving cells were fixed and stained with 50% methanol and 1% crystal violet (Panel (a) of FIG. 27). Cells were then photographed in a Chemidoc™ and the absorbance was measured by dissolving the crystal violet in 1% SDS and taking measurements at 570 nm (Panel (b) of FIG. 27).

The highly active CDA A0A2K5RDN7 shows high editing efficiency, but it also exhibits a high degree of cell toxicity (Panel (a) of FIG. 27). The deaminases were assayed as base editors (fused to MG3-6) and stably expressed in HEK293T cells. MG93-3 and MG93-4 both showed much less cellular toxicity than A0A2K5RDN7. Quantification of the toxicity assay (Panel (b) of FIG. 27) shows that MG93-3 and MG93-4 are less toxic than rAPOBEC.

Example 26—Directed Evolution of Adenosine Deaminase in *E. coli*

MG68-4 harboring a D109N mutation can improve DNA editing efficiency in *E. coli*. For simplicity, this variant was designated r1v1. To further improve the efficiency for editing in mammalian cells, the deaminase portion of MG68-4 (D109N)-nMG34-1 was randomly mutagenized by error prone PCR. The resulting library was tested for the editing activity of variants by an *E. coli* positive selection using chloramphenicol acetyltransferase with H193Y mutation.

To perform this experiment, the gene fragment of MG68-4 (D109N) was mutagenized by GeneMorph II Random mutagenesis kit according to the manufacturer's instructions. In general, 500 ng DNA template was used, and 20 cycles of PCR reaction was carried out to get a mutation frequency ranging from 0 to 4.5 mutations/kb. The vector pAL478 carrying nMG34-1, CAT (H193Y), and single guide expression cassette was linearized by SacII and KpnI digestion. PCR products from random mutagenesis were then cloned into the linearized vector by NEBuilder® HiFi DNA assembly kit. The assembled product was transformed into BL21(DE3) (Lucigen), recovered with recovery media, and plated on LB agar plates containing 100 μg/mL carbenicillin, 0.1 mM IPTG, and chloramphenicol with concentrations of 2, 4, and 8 μg/mL. After bacterial selection, 260 colonies from plates of 4 and 8 μg/mL chloramphenicol were picked and sequenced by Sanger sequencing at Elim Biopharmaceuticals. Colonies carrying point mutations on MG68-4 (D109N) were grown in 96-well deep well plates and pooled together. Plasmids of these cells were isolated using QIAprep Spin Miniprep Kit (Qiagen) and MG68-4 variants were subcloned into pAL478 by digestion and ligation using restriction enzymes (SacII and KpnI) and T4 DNA ligase, respectively. The resulting library was transformed into Endura electrocompetent cells (Lucigen), amplified, and isolated by miniprep. Collected DNA was transformed into BL21(DE3) and tested for deaminase activity using chloramphenicol selection with concentrations of 2, 16, 32, 64, and and 128 μg/mL. 128 colonies (which were understood to contain mutations that facilitated deaminase activity of the MG68 enzyme and survival under chloramphenicol selection) from plates of 32, 64, and 128 μg/mL chloramphenicol were picked and sequenced by Sanger sequencing.

A total of 25 variants (r2v1 to r2v24 (SEQ ID NOs. 837-860) were uncovered and mutations were confirmed by Sanger sequencing. Through this evolution process, 24 residues were identified that were mutated to other amino acids (FIG. 28). These mutants contained mutations at T2 (e.g. T2A), D7 (e.g. D7G), E10 (e.g. E10G), M13 (e.g. M13R), W24 (e.g. W24G), G32 (e.g. G32A), K38 (e.g. K38E), G45 (e.g. G45D), G51 (e.g. G51V), A63 (e.g. A63S), E66 (e.g. E66V or E66D), R75 (e.g. R75H), C91 (e.g. C91R), G93 (e.g. G93W), H97 (e.g. H97Y or H97L), A107 (e.g. A107V), E108 (e.g. E108D), D109 (e.g. D109N), P110 (e.g. P110H), H124 (e.g. H124Y), A126 (e.g. A126D), H129 (e.g. H129R or H129N), F150 (e.g. F150P or F150S), S165 (e.g. S165L).

Example 27—Adenine Base Editors in Mammalian Cells

Variants of adenine base editors identified from *E. coli* selection in Example 27 were codon-optimized for mammalian cell expression and tested in HEK293T cells. Four guides were designed to test A to G conversion in cells (SEQ ID NOs. 861-864 for spacers and SEQ ID NO. 876 for MG34-1 guide scaffold). 11 variants (r2v3, r2v5, r2v7, r2v8, r2v11, r2v12, r2v13, r2v14, r2v15, r2v16, and r2v23 (SEQ ID NOs. 839, 841, 843, 844, 847, 848, 849, 850, 851, 852, and 859) outperformed r1v1 in the first three guides screened. When the mutations were displayed on the predicted structure of MG68-4, it was found that five residues (W24, G51, E108, P110, and F150) surrounding the active site were changed. Notably, r2V7 (D7G and E10G (SEQ ID NO. 843)) and r2V16 (H129N (SEQ ID NO. 852)), while containing mutations away from the active site, displayed greater improvement of editing efficiencies than other mutations (FIG. 29). With this round of screening, editing efficiency of r1v1 was increased from 2.8% to 7.9% on r2v7 and from 2.8% to 9.09% on r2v16 when guide 2 was used (FIG. 30).

Example 28—Deaminase Activity on ssRNA (Prophetic)

This protocol was adapted from Wolfe, et. al. (NAR Cancer, 2020, Vol. 2, No. 4 1 doi: 10.1093/narcan/zcaa027). Linear DNA constructs containing the CDA and A1CF, a cofactor, are amplified from constructs prepared by Twist (SEQ ID NO. 741) using the same primers developed for the in gel assay on ssDNA. Constructs are cleaned by PCR Spin Column Cleanup (Qiagen) and analyzed by gel electrophoresis. Enzymes, are expressed from the PCR templates in an in vitro transcription-translation system, PURExpress (NEB), at 37° C. for 2.5 hours. Deamination reactions are prepared by mixing 2 uLs of the PURExpress reaction (CDA and A1CF) with 2 uM ssRNA substrate (IDT, SEQ ID NO. 742) in the presence of an RNAse inhibitor and incubating at 3C for 2 hours. 5' FAM labeled DNA primer (IDT, SEQ ID NO. 743) is then added to a concentration of 1.3 uM. The reaction is heated at 95° C. for 10 minutes and then allowed to cool gradually to room temperature for at least 30 minutes. Then. a reverse transcription mastermix comprising 5 mM DTT, Protoscript® II RT (NEB) (5 U/μL), Protoscript® II Buffer (NEB) (1×). RNAeOut (ThermoFisher) (0.4 U/μL), dTTP (0.25 mM) dCTP (0.25 mM), dATP (0.25 mM), and ddGTP (5 mM) is added. A full length transcription product is produced when the RNA substrate is deaminated. In contrast, when there is no deamination, a "C" will remain in the RNA substrate, and the reverse transcription reaction will terminate upon incorporation of ddGTP opposite this C. The reaction is incubated at 42° C. for one hour, and then at 65° C. for 10 minutes. Aliquots are then mixed with 2×RNA loading dye (NEB) and heated at 75° C. for 10 minutes, then cooled on ice for two minutes. Samples are loaded onto 10% or 15% Urea-TBE denaturing gels (Biorad). DNA bands are visualized by a Chemi-Doc™ imager (Biorad). Successful deamination is observed by the visualization of a full length (55 bp) fluorescently labeled band in the gel. Non-deaminated products appear as shorter (43 bp) fluorescently labeled bands.

Example 29—Increased Cytosine Base Editing Efficiency Upon Fam72a Expression

Fam72a has been documented as opposing uracil DNA glycosylase (UDG) during B cell somatic hypermutation and class-switch recombination to prevent mismatch-repair-based correction of mutated Immunoglobulin alleles. Expression of Fam72a during engineered cytosine base editing may suppress UDG activity and thereby increase the conversion targeted of C into T.

HEK293 cells (150,000) were lipofected using JetOptimus according to the manufacturer's instructions with plasmids encoding a Cas9-CBE fusion (pMG3078; 500 ng), a plasmid encoding either sgRNA PE266 or PE691 (250 ng), and a plasmid encoding either Fam72a (pMG3072; 500 ng) or not. Cells were harvested 72 hours post-transfection, genomic DNA prepared, and the degree of base editing was determined via computational analysis of next-generation sequencing reads (FIG. 32). The CMV-driven Fam72a expression construct demonstrated increased CBE activity at two loci when Fam72a was co-expressed with a Cas9-based cytosine base editor. It was determined that Fam72a can be useful to improve cytosine base editing (CBE) with any type of cytosine base editor, not just Cas9-based constructs.

Example 30—Structural Optimization of Adenine Base Editors 33 rationally-designed ABE variants were constructed for use in mammalian cells under control of a CMV promoter (SEQ ID NOs: 1128-1160). Eights constructs contained ABEs with a MG68-4 (D109N) adenine deaminase fused to either the N- or C-terminus of a MG3-6/3-8 nickase enzyme (D13A) with linker lengths of 20, 36, 48, and 62 amino acid residues. Additionally, 25 constructs contained ABEs with an MG68-4 (D109N) adenine deaminase inlaid within the RUVC-I, REC, HNH, RUVC-III, or WED domains with 18 amino acid linkers fused to either end. These constructs are summarized in Table 12A.

TABLE 12A

Rationally-designed ABE Variants from Example 30

| SEQ ID NO: | Description | Fusion/Inlaid position* | MG3-6/3-8 Domain Containing Inlaid MG68-4 |
|---|---|---|---|
| 1128 | 3-68_DIV1_M_RDr1v1_B | N-term 36AA linker | N-terminal fusion |
| 1129 | 3-68_DIV2_M_RDr1v1_B | N-term 48AA linker | N-terminal fusion |
| 1130 | 3-68_DIV3_M_RDr1v1_B | N-term 62AA linker | N-terminal fusion |
| 1131 | 3-68_DIV4_M_RDr1v1_B | N-term 20AA linker | N-terminal fusion |
| 1132 | 3-68_DIV5_M_RDr1v1_B | C-term 36AA linker | C-terminal fusion |
| 1133 | 3-68_DIV6_M_RDr1v1_B | C-term 48AA linker | C-terminal fusion |
| 1134 | 3-68_DIV7_M_RDr1v1_B | C-term 62AA linker | C-terminal fusion |
| 1135 | 3-68_DIV8_M_RDr1v1_B | C-term 20AA linker | C-terminal fusion |
| 1136 | 3-68_DIV9_M_RDr1v1_B | Inlaid 26AA | RUVC-I |
| 1137 | 3-68_DIV10_M_RDr1v1_B | Inlaid 202AA | REC |
| 1138 | 3-68_DIV11_M_RDr1v1_B | Inlaid 262AA | REC |
| 1139 | 3-68_DIV12_M_RDr1v1_B | Inlaid 297AA | REC |
| 1140 | 3-68_DIV13_M_RDr1v1_B | Inlaid 335AA | REC |
| 1141 | 3-68_DIV14_M_RDr1v1_B | Inlaid 409AA | REC |
| 1142 | 3-68_DIV15_M_RDr1v1_B | Inlaid 537AA | Between Linker 1 and HNH |
| 1143 | 3-68_DIV16_M_RDr1v1_B | Inlaid 550AA | HNH |
| 1144 | 3-68_DIV17_M_RDr1v1_B | Inlaid 575AA | HNH |
| 1145 | 3-68_DIV18_M_RDr1v1_B | Inlaid 591AA | HNH |
| 1146 | 3-68_DIV19_M_RDr1v1_B | Inlaid 615AA | HNH |
| 1147 | 3-68_DIV20_M_RDr1v1_B | Inlaid 657AA | HNH |
| 1148 | 3-68_DIV21_M_RDr1v1_B | Inlaid 661AA | HNH |
| 1149 | 3-68_DIV22_M_RDr1v1_B | Inlaid 688AA | Between Linker 2 and |

TABLE 12A-continued

| Rationally-designed ABE Variants from Example 30 | | | |
|---|---|---|---|
| SEQ ID NO: | Description | Fusion/Inlaid position* | MG3-6/3-8 Domain Containing Inlaid MG68-4 |
| | | | RUVC-III |
| 1150 | 3-68_DIV23_M_RDr1v1_B | Inlaid 696AA | RUVC-III |
| 1151 | 3-68_DIV24_M_RDr1v1_B | Inlaid 717AA | RUVC-III |
| 1152 | 3-68_DIV25_M_RDr1v1_B | Inlaid 768AA | RUVC-III |
| 1153 | 3-68_DIV26_M_RDr1v1_B | Inlaid 771AA | RUVC-III |
| 1154 | 3-68_DIV27_M_RDr1v1_B | Inlaid 775AA | RUVC-III |
| 1155 | 3-68_DIV28_M_RDr1v1_B | Inlaid 782AA | RUVC-III |
| 1156 | 3-68_DIV29_M_RDr1v1_B | Inlaid 788AA | RUVC-III |
| 1157 | 3-68_DIV30_M_RDr1v1_B | Inlaid 791AA | RUVC-III |
| 1158 | 3-68_DIV31_M_RDr1v1_B | Inlaid 836AA | Between RUVC-III and WED |
| 1159 | 3-68_DIV32_M_RDr1v1_B | Inlaid 866AA | WED |
| 1160 | 3-68_DIV33_M_RDr1v1_B | Inlaid 887AA | WED |

*Inlaid denotes the upstream native residue after which the deaminase is inserted. For example, "Inlaid 887AA" indicates that the deaminase is inlaid between amino acids 887 and 888.

Plasmids expressing the 33 ABE variants were separately transiently co-transfected into HEK293 cells with plasmids expressing 8 sgRNAs (SEQ ID NOs: 1188-1195) targeting a specific locus in the human genome. After 72 hours, cells were harvested and analyzed for on-target editing (FIG. 36 and Table 12B).

TABLE 12B

| Frequency of base editing detected for the HEK293T editing experiment of Example 30 | | | | | | | | | | | | |
|---|---|---|---|---|---|---|---|---|---|---|---|---|
| Construct | Insertion Site | Linker Length | A1 (A to G %) | A3 (A to G %) | A5 (A to G %) | A7 (A to G %) | A8 (A to G %) | A9 (A to G %) | A10 (A to G %) | A18 (A to G %) | A20 (A to G %) | A22 (A to G %) |
| 3-68_DIV1_M_RDr1v1_B | N-terminal insertion | 36AA linker | 0.1 | 0.005 | 0.655 | 0.05 | 0.465 | 0.24 | 0.65 | 0.03 | 0.1 | 0.03 |
| 3-68_DIV2_M_RDr1v1_B | N-terminal insertion | 48AA linker | 0.045 | 0.01 | 1.185 | 0.325 | 0.76 | 0.5 | 1.325 | 0.035 | 0.085 | 0.01 |
| 3-68_DIV3_M_RDr1v1_B | N-terminal insertion | 62AA linker | 0.03 | 0.02 | 1.315 | 0.22 | 0.575 | 0.19 | 1.56 | 0.05 | 0.09 | 0.03 |
| 3-68_DIV4_M_RDr1v1_B | N-terminal insertion | 20AA linker | | | | | | | | | | |
| 3-68_DIV5_M_RDr1v1_B | C-terminal insertion | 36AA linker | 0.04 | 0.015 | 0.08 | 0.045 | 0.095 | 0.32 | 1.86 | 0.035 | 0.075 | 0.025 |
| 3-68_DIV6_M_RDr1v1_B | C-terminal insertion | 48AA linker | 0.03 | 0.015 | 0.39 | 0.05 | 0.215 | 0.655 | 4.065 | 0.04 | 0.095 | 0.025 |
| 3-68_DIV7_M_RDr1v1_B | C-terminal insertion | 62AA linker | 0.015 | 0.02 | 0.205 | 0.535 | 0.555 | 0.905 | 5.45 | 0.025 | 0.095 | 0.02 |
| 3-68_DIV8_M_RDr1v1_B | C-terminal insertion | 20AA linker | 0.025 | 0.015 | 0.29 | 0.125 | 0.14 | 0.14 | 1.16 | 0.05 | 0.12 | 0.03 |
| 3-68_DIV9_M_RDr1v1_B | Inlaid 26AA | 18AA linker | | | | | | | | | | |
| 3-68_DIV10_M_RDr1v1_B | Inlaid 202AA | 18AA linker | 0.025 | 0.035 | 0.14 | 0.05 | 0.03 | 0.46 | 4.26 | 0.105 | 0.08 | 0.025 |
| 3-68_DIV11_M_RDr1v1_B | Inlaid 262AA | 18AA linker | | | | | | | | | | |
| 3-68_DIV12_M_RDr1v1_B | Inlaid 297AA | 18AA linker | 0.01 | 0.015 | 5.86 | 2.14 | 1.635 | 2.495 | 6.18 | 0.085 | 0.123 | 0.02 |
| 3-68_DIV13_M_RDr1v1_B | Inlaid 335AA | 18AA linker | | | | | | | | | | |
| 3-68_DIV14_M_RDr1v1_B | Inlaid 409AA | 18AA linker | | | | | | | | | | |
| 3-68_DIV15_M_RDr1v1_B | Inlaid 537AA | 18AA linker | 0.02 | 0.015 | 0.165 | 0.04 | 0.08 | 0.1 | 0.805 | 0.03 | 0.06 | 0.06 |
| 3-68_DIV16_M_RDr1v1_B | Inlaid 550AA | 18AA linker | 0.03 | 0.015 | 0.26 | 0.12 | 0.345 | 0.345 | 2.62 | 0.025 | 0.09 | 0.015 |
| 3-68_DIV17_M_RDr1v1_B | Inlaid 575AA | 18AA linker | | | | | | | | | | |
| 3-68_DIV18_M_RDr1v1_B | Inlaid 591AA | 18AA linker | | | | | | | | | | |
| 3-68_DIV19_M_RDr1v1_B | Inlaid 615AA | 18AA linker | 0.04 | 0.01 | 0.075 | 0.015 | 0.075 | 0.16 | 1.05 | 0.025 | 0.095 | 0.015 |
| 3-68_DIV20_M_RDr1v1_B | Inlaid 657AA | 18AA linker | | | | | | | | | | |
| 3-68_DIV21_M_RDr1v1_B | Inlaid 661AA | 18AA linker | 0.045 | 0.025 | 0.43 | 0.065 | 0.315 | 0.4 | 3.305 | 0.03 | 0.04 | 0.015 |
| 3-68_DIV22_M_RDr1v1_B | Inlaid 688AA | 18AA linker | | | | | | | | | | |
| 3-68_DIV23_M_RDr1v1_B | Inlaid 696AA | 18AA linker | | | | | | | | | | |
| 3-68_DIV24_M_RDr1v1_B | Inlaid 717AA | 18AA linker | | | | | | | | | | |
| 3-68_DIV25_M_RDr1v1_B | Inlaid 768AA | 18AA linker | 0.135 | 0.015 | 6.395 | 1.52 | 3.595 | 4.615 | 12.8 | 0.025 | 0.045 | 0.025 |
| 3-68_DIV26_M_RDr1v1_B | Inlaid 771AA | 18AA linker | 0.275 | 0.11 | 6.855 | 1.67 | 3.81 | 4.285 | 12.98 | 0.015 | 0.035 | 0.01 |
| 3-68_DIV27_M_RDr1v1_B | Inlaid 775AA | 18AA linker | 0.09 | 0.04 | 5.87 | 1.515 | 3.245 | 4.54 | 11.65 | 0.015 | 0.075 | 0.02 |
| 3-68_DIV28_M_RDr1v1_B | Inlaid 782AA | 18AA linker | 0.105 | 0.125 | 5.84 | 1.98 | 3.68 | 4.315 | 12.705 | 0.035 | 0.08 | 0.01 |
| 3-68_DIV29_M_RDr1v1_B | Inlaid 788AA | 18AA linker | 0.15 | 0.045 | 4.57 | 1.475 | 2.07 | 2.85 | 8.215 | 0.015 | 0.065 | 0.025 |
| 3-68_DIV30_M_RDr1v1_B | Inlaid 791AA | 18AA linker | 0.32 | 0.18 | 6.545 | 2.99 | 3.44 | 4.25 | 13.295 | 0.02 | 0.07 | 0.04 |
| 3-68_DIV31_M_RDr1v1_B | Inlaid 836AA | 18AA linker | | | | | | | | | | |
| 3-68_DIV32_M_RDr1v1_B | Inlaid 866AA | 18AA linker | | | | | | | | | | |
| 3-68_DIV33_M_RDr1v1_B | Inlaid 887AA | 18AA linker | | | | | | | | | | |
| Background | N/A | N/A | 0.015 | 0.015 | 0.005 | 0.03 | 0.025 | 0.035 | 0.245 | 0.03 | 0.075 | 0.025 |

Sequencing results showed that 19 of the 33 ABEs were capable of on-target editing at a level of at least 1% editing when co-expressed with an sgRNA targeting the TRAC locus (FIG. 33). Constructs used in this experiment included 3-68_DIV1_M_RDr1v1_B, 3-68_DIV2_M_RDr1v1_B, 3-68_DIV3_M_RDr1v1_B, 3-68_DIV4_M_RDr1v1_B, 3-68 DIV5_M_RDr1v1_B, 3-68 DIV6_M_RDr1v1_B, 3-68 DIV7_M_RDr1v1_B, 3-68_DIV8_M_RDr1v1_B, 3-68_DIV9_M_RDr1v1_B, 3-68_DIV10_M_RDr1v1_B, 3-68_DIV11_M_RDr1v1_B, 3-68_DIV12_M_RDr1v1_B, 3-68_DIV13_M_RDr1v1_B, 3-68_DIV14_M_RDr1v1_B, 3-68_DIV15_M_RDr1v1_B, 3-68_DIV16_M_RDr1v1_B, 3-68 DIV17_M_RDr1v1_B, 3-68 DIV18_M_RDr1v1_B, 3-68 DIV19_M_RDr1v1_B, 3-68_DIV20_M_RDr1v1_B, 3-68_DIV21_M_RDr1v1_B, 3-68_DIV22_M_RDr1v1_B, 3-68_DIV23_M_RDr1v1_B, 3-68_DIV24_M_RDr1v1_B, 3-68_DIV25_M_RDr1v1_B, 3-68_DIV26_M_RDr1v1_B, 3-68_DIV27_M_RDr1v1_B, 3-68_DIV28_M_RDr1v1_B, 3-68 DIV29_M_RDr1v1_B, 3-68 DIV30_M_RDr1v1_B, 3-68 DIV31_M_RDr1v1_B, 3-68_DIV32_M_RDr1v1_B, and 3-68_DIV33_M_RDr1v1_B (FIG. 36). The construct with the highest levels of editing of any A residue within the spacer region was 3-68_DIV30_M_RDr1v1_B, with a maximum on-target editing rate of 13.3% (n=2) (FIG. 33). Also of note was 3-68_DIV12_M_RDr1v1_B, which displayed similar editing levels between A5 (5.86%) and A10 (6.18%), indicating that v12 may have an altered base editing window within the spacer region relative to the other active ABEs. In addition to evaluating on-target editing, the cell viability of each base editor/sgRNA co-transfection was visually assessed. Cells transfected with numerous constructs, including 3-68_DIV30_M_RDr1v1_B and 3-68_DIV12_M_RDr1v1_B, had high cell viability, whereas many cells transfected with the N- or C-terminally fused constructs had low cell viability.

Example 31—Engineering of the Adenosine Deaminase

As tRNA adenosine deaminase (TadA) from *E. coli* has been engineered to target DNA and improve the base editing activity in mammalian cells, it was postulated that porting analogous mutations documented to improve editing in EcTadA to MG68-4 (D109N) may improve the deaminase activity. By surveying the literature, mutations of EcTadA from ABE7.10, ABE8.8m, ABE8.17m, and ABE8e were collected. The equivalent residues on MG68-4 were parsed out through multiple sequence alignment and structural alignment. 22 rationally designed variants on top of MG68-4 (D109N) were generated and fused to the N-terminus of MG34-1 (D10A) (SEQ ID NOs: 1161-1183). To import base editors into the nucleus, a nuclear localization signal (NLS) was incorporated to the c-terminus of the enzyme. The effect of dual NLS system (e.g. on both N- and C-termini) on editing efficiency was evaluated (FIGS. 34A and 34B) (SEQ ID NOs: 1184-1186). Genes of base editors and guide RNAs were coexpressed by CMV and U6 promoters, respectively. In this experiment, single plasmids carrying required editing components (SEQ ID NOs: 1187 and 1207) were transfected into HEK293T cells, and editing efficiencies were evaluated through NGS. The results showed that the top three performers (RD9, RD18, and RD5) achieved 27.4%, 26.6%, and 23.8% A to G conversion on A8, respectively. A 45% increase in editing efficiency was obtained when comparing RD9 (MG68-4 (D109N/T112R)) to MGA1.1 (MG68-4 (D109N)). The two-NLS design had comparable activity to the one-NLS design. MGA1.1_2NLS achieved 11.4% conversion, which is lower than 19.2% MGA1.1 (FIG. 35).

Example 32—Engineered CBEs to Relax Sequence Selectivity of CDA at −1 Position of the Target Cytosine and Improved On-Target Activity on DNA Two approaches were taken toward mutagenesis to improve the editing activity and selectivity for cytosine base editors (CBEs). First, as it was hypothesized that low or mid-editing efficiency and nickase-independent deamination events of wild-type CBEs may be caused by the intrinsic DNA/RNA binding affinities of the cytidine deaminase(s), mutagenesis (point mutation) of cytidine deaminases to alter intrinsic DNA/RUNA affinity was considered. Second, as a loop adjacent to the active site has been identified as important for determining selectivity at the −1 position relative to the targeted cytosine in related families of base editors (loop 7, Kolhi et al., *J. Biol. Chem* 2009, 284, 22898-22904), experiments to swap loop 7 sequences among cytosine base editors were considered.

Utilizing structural-based homology models of APOBEC1 (Wolfe et al., *NAR Cancer* 2020, 2, 1-15), AID (Kolhi et al., J Biol. Chem. 2009, 284, 22898-22904), and APOBEC3A (Shi et al., *Nat Struct Mol Biol.* 2017, 24, 131-139), the putative loop 7 of novel cytidine deaminases described herein were predicted and identified in order to develop a loop 7 swapping experiment to relax the sequence selectivity of these candidates. Several residues were also targeted for mutation to increase activity on DNA and reduce RNA activity (Yu et al., Nature Communications 2020, 11, 2052). A total of 108 CDA variants (with MG93, MG139 and MG152 families) were designed with either a point mutation or a loop 7 swapping with AID deaminase that is documented to have a 5'RC selectivity (SEQ ID NOs: 1208-1315).

TABLE 12C

Cytosine Base Editor Mutants Investigated in Example 32

| SEQ ID NO: | Description | Nomenclature in Experiments | Background enzyme for mutation |
|---|---|---|---|
| 1208 | W90A | MG93_4v1 | MG93-4 |
| 1209 | W90F | MG93_4v2 | MG93-4 |
| 1210 | W90H | MG93_4v3 | MG93-4 |
| 1211 | W90Y | MG93_4v4 | MG93-4 |
| 1212 | Y120F | MG93_4v5 | MG93-4 |
| 1213 | Y120H | MG93_4v6 | MG93-4 |
| 1214 | Y121F | MG93_4v7 | MG93-4 |
| 1215 | Y121H | MG93_4v8 | MG93-4 |
| 1216 | Y121Q | MG93_4v9 | MG93-4 |
| 1217 | Y121A | MG93_4v10 | MG93-4 |
| 1218 | Y121D | MG93_4v11 | MG93-4 |
| 1219 | Y121W | MG93_4v12 | MG93-4 |
| 1220 | H122Y | MG93_4v13 | MG93-4 |
| 1221 | H122F | MG93_4v14 | MG93-4 |
| 1222 | H122I | MG93_4v15 | MG93-4 |
| 1223 | H122A | MG93_4v16 | MG93-4 |
| 1224 | H122W | MG93_4v17 | MG93-4 |
| 1225 | H122D | MG93_4v18 | MG93-4 |
| 1226 | Replace with hAID loop7 | MG93_4v19 | MG93-4 |
| 1227 | Replace with 139_86 loop 7 | MG93_4v20 | MG93-4 |
| 1228 | Truncate from 188 to end | MG93_4v21 | MG93-4 |
| 1229 | Y121T | MG93_4v22 | MG93-4 |
| 1230 | Replace with a smaller section of hAID loop7 | MG93_4v23 | MG93-4 |
| 1231 | Replace with a smaller section of hAID loop7 | MG93_4v24 | MG93-4 |

TABLE 12C-continued

Cytosine Base Editor Mutants Investigated in Example 32

| SEQ ID NO: | Description | Nomenclature in Experiments | Background enzyme for mutation |
|---|---|---|---|
| 1232 | R33A | MG93_4v25 | MG93-4 |
| 1233 | R34A | MG93_4v26 | MG93-4 |
| 1234 | R34K | MG93_4v27 | MG93-4 |
| 1235 | H122A R33A | MG93_4v28 | MG93-4 |
| 1236 | H122A R34A | MG93_4v29 | MG93-4 |
| 1237 | R52A | MG93_4v30 | MG93-4 |
| 1238 | H122A R52A | MG93_4v31 | MG93-4 |
| 1239 | N57G (Shown to have lower off target activity in A3A) | MG93_4v32 | MG93-4 |
| 1240 | N57G H122A | MG93_4v33 | MG93-4 |
| 1241 | Replace with A3A loop7 | MG139_86v1 | MG139-86 |
| 1242 | E123A | MG139_95v1 | MG139-95 |
| 1243 | E123Q | MG139_95v2 | MG139-95 |
| 1244 | Replace with hAID loop7 | MG93_3v1 | MG93-3 |
| 1245 | Replace with 139_86 loop 7 | MG93_3v2 | MG93-3 |
| 1246 | W127F | MG93_3v3 | MG93-3 |
| 1247 | W127H | MG93_3v4 | MG93-3 |
| 1248 | W127Q | MG93_3v5 | MG93-3 |
| 1249 | W127A | MG93_3v6 | MG93-3 |
| 1250 | W127D | MG93_3v7 | MG93-3 |
| 1251 | R39A | MG93_3v8 | MG93-3 |
| 1252 | K40A | MG93_3v9 | MG93-3 |
| 1253 | H128A | MG93_3v10 | MG93-3 |
| 1254 | N63G | MG93_3v11 | MG93-3 |
| 1255 | R58A | MG93_3v12 | MG93-3 |
| 1256 | Replace with hAID loop7 | MG93_11v1 | MG93-11 |
| 1257 | Replace with 139_86 loop 7 | MG93_11v2 | MG93-11 |
| 1258 | H121F | MG93_11v3 | MG93-11 |
| 1259 | H121Y | MG93_11v4 | MG93-11 |
| 1260 | H121Q | MG93_11v5 | MG93-11 |
| 1261 | H121A | MG93_11v6 | MG93-11 |
| 1262 | H121D | MG93_11v7 | MG93-11 |
| 1263 | H121W | MG93_11v8 | MG93-11 |
| 1264 | N57G (Shown to have lower off target activity in A3A) | MG93_11v9 | MG93-11 |
| 1265 | R33A | MG93_11v10 | MG93-11 |
| 1266 | K34A | MG93_11v11 | MG93-11 |
| 1267 | H122A | MG93_11v12 | MG93-11 |
| 1268 | H121A | MG93_11v13 | MG93-11 |
| 1269 | R52A | MG93_11v14 | MG93-11 |
| 1270 | K16 through P25 of pgtA3H replaces G20 through P26 | 139_52v1 | MG139-52 |
| 1271 | S170 through D138 of pgtA3H replaces K196 to V215 | 139_52v2 | MG139-52 |
| 1272 | P26R | 139_52v3 | MG139-52 |
| 1273 | P26A | 139_52v4 | MG139-52 |
| 1274 | N27R | 139_52v5 | MG139-52 |
| 1275 | N27A | 139_52v6 | MG139-52 |
| 1276 | W44A (equivalent to R52A) | 139_52v7 | MG139-52 |
| 1277 | W45A (equivalent to R52A) | 139_52v8 | MG139-52 |
| 1278 | K49G (equivalent to N57G) | 139_52v9 | MG139-52 |
| 1279 | S50G (equivalent to N57G) | 139_52v10 | MG139-52 |
| 1280 | R51G (equivalent to N57G) | 139_52v11 | MG139-52 |
| 1281 | R121A (equivalent to H121A) | 139_52v12 | MG139-52 |
| 1282 | I122A (equivalent to H122A) | 139_52v13 | MG139-52 |
| 1283 | N123A (equivalent to H122A) | 139_52v14 | MG139-52 |
| 1284 | Y88F (equivalent to W90F) | 139_52v15 | MG139-52 |
| 1285 | Y120F (equivalent to Y120F) | 139_52v16 | MG139-52 |
| 1286 | P22R | 139_86v2 | MG139-86 |
| 1287 | P22A | 139_86v3 | MG139-86 |
| 1288 | K23A | 139_86v4 | MG139-86 |
| 1289 | K41R | 139_86v5 | MG139-86 |
| 1290 | K41A | 139_86v6 | MG139-86 |
| 1291 | truncate K179 and onwards | 139_86v7 | MG139-86 |
| 1292 | Insert hAID loop 7 and truncate K179 onwards | 139_86v8 | MG139-86 |
| 1293 | E54D and truncation | 139_86v9 | MG139-86 |
| 1294 | E54A Mutate catalytic E residue | 139_86v10 | MG139-86 |
| 1295 | Mutate neighboring E residue | 139_86v11 | MG139-86 |
| 1296 | E54AE55A Mutate both catalytic E residues | 139_86v12 | MG139-86 |
| 1297 | K30A | 152_6v1 | MG152-6 |
| 1298 | K30R | 152_6v2 | MG152-6 |
| 1299 | M32A | 152_6v3 | MG152-6 |
| 1300 | M32K | 152_6v4 | MG152-6 |
| 1301 | Y117A | 152_6v5 | MG152-6 |
| 1302 | K118A | 152_6v6 | MG152-6 |
| 1303 | I119A | 152_6v7 | MG152-6 |
| 1304 | I119H | 152_6v8 | MG152-6 |
| 1305 | R120A | 152_6v9 | MG152-6 |
| 1306 | R121A | 152_6v10 | MG152-6 |
| 1307 | P46A | 152_6v11 | MG152-6 |
| 1308 | P46R | 152_6v12 | MG152-6 |
| 1309 | N29A | 152_6v13 | MG152-6 |
| 1310 | Loop 7 from MG138-20 | 152_6v14 | MG152-6 |
| 1311 | Loop 7 from MG139-12 | 152_6v15 | MG152-6 |
| 1312 | R27A | 138_20v1 | MG138-20 |
| 1313 | N50G | 138_20v2 | MG138-20 |
| 1314 | Loop 7 from MG138-20 | 139_52v17 | MG139-52 |
| 1315 | Loop 7 from MG139-12 | 139_52v18 | MG139-52 |

Example 33—In Vitro Activity of Novel CDA Variants from the MG93, MG139, and MG152 Families

In Vitro Deaminase in-Gel Assay

Linear DNA constructs containing the CDA were amplified from the previously mentioned plasmids from Twist via PCR. All constructs were cleaned via SPRI Cleanup (Lucigen) and eluted in a 10 mM tris buffer. Enzymes were expressed from the PCR templates in an in vitro transcription-translation system, PURExpress (NEB), at 37° C. for 2 hours. Deamination reactions were prepared by mixing 2 μL of the PURExpress reaction with 2 μM 5 FAM labeled ssDNA (IDT) (4 different ssDNA substrates were used with different −1 nucleobase (A or C or T or G) next to the target cytidine (SEQ ID NOs: 1316-1319; FIG. 37) or with 0.5 μM Cy3 and Cy5.5 labeled ssDNA (IDT, 2 different substrates with either AC vs GC or CC vs TC, SEQ ID NOs: 1320-1321; FIG. 38) and IU USER Enzyme (NEB) in 1× Cutsmart Buffer (NEB). The reactions were incubated at 37° C. for 2 hours and then quenched by adding 4 units of proteinase K (NEB) and incubating at 55° C. for 10 minutes. The reaction was further treated by addition of 11 μL of 2×RNA loading dye and incubation at 75° C. for 10 minutes. All reaction conditions were analyzed by gel electrophoresis in a 10% denaturing gel (Biorad). DNA bands were visualized by a Chemi-Doc™ imager (Biorad) and band intensities were quantified using BioRad Image Lab™ v6.0 (FIG. 39). Successful deamination is observed by the visualization of a 10 bp fluorescently labeled band in the gel.

The deamination of cytosine (C) is catalyzed by cytidine deaminases and results in uracil (U), which has the base-pairing properties of thymine (T). Most documented cytidine deaminases operate on RNA, and the few examples that are documented to accept DNA require single-stranded DNA (ssDNA). The in vitro activity of 108 CDAs on 4 ssDNA substrates containing cytosine in all four possible 5'-NC contexts was measured (FIGS. 37 and 38). The percentage of deamination for each nucleobase at 1-nt position was also calculated to evaluate if the selected mutations altered the sequence selectivity of the designed variants in vitro (FIGS. 39 and 40). Notably, several variants display a more relaxed sequence base selectivity for MG93 and MG139 families (FIGS. 39 and 40) and were selected for downstream in vivo mammalian cell activity as full CBEs.

Example 34—Mammalian Editing Activity of Novel and Engineered CDAs as CBEs

In order to test the activity of novel CDAs as well as engineered variants, an engineered cell line was devised with 5 consecutive PAMs compatible with MG3-6 and Cas9. This cell line allows for gRNA tiling to test editing efficiency and find −1 nt selectivity.

In order to test the novel and engineered CDAs, the CDAs were cloned in a plasmid backbone containing MG3-6. The CDAs were cloned in the N termini. Once the cloning of novel and variant CDAs was confirmed, they were transiently transfected into the engineered HEK293T cells using Lipofectamine™ 2000. A total of 32 novel CDAs and 2 engineered variants (139-52-V6 and 93-4-V16) were tested in the gRNA tiling experiment described above (SEQ ID NOs: 1322-1355). Out of the 34 tested CDAs. 22 showed editing activity higher than 1% (FIG. 41A). The top performers were MG152-6, MG139-52v6, MG93-4, MG139-52, MG139-94, MG93-7, MG93-3, MG139-12, MG139-103, MG139-95, MG139-99, MG139-90, MG139-89, MG139-93, MG138-30, MG139-102, MG93-4v16, MG152-5, MG138-20, MG138-23, MG93-5, MG152-4, and MG152-1. When the editing activity was normalized per experimental condition relative to a positive control (documented high activity CDA: A0A2K5RDN7), it was observed that 9 candidates showed at least 20% the activity of the A0A2K5RDN7 positive control (FIG. 41B). Amongst these 9 candidates, 3 of them showed at least 50% the activity of A0A2K5RDN7; 139-52-V6, 152-6, and 139-52 showed 95%, 65%, and 60% of the activity, respectively. FIG. 41C shows side by side comparison of 2 targeting spacers. 139-52-V6 shows essentially the same editing activity as A0A2K5RDN7, as observed in FIG. 41C.

To characterize the −1 nt selectivity. 16 candidates of interest were selected. The −1 nt mammalian cell selectivity was calculated by selecting the top 4 modified cytosines per guide RNA and calculating the ratio per −1 position. The analysis was restricted to cytosines with >1% editing. The average ratio for all 5 guides were plotted. The −1 nt in vitro selectivity was plotted by calculating the sun of percentage cleavages (percent cleavage measures percent deamination) per −1 nt selectivity and then calculating the ratio per −1 nucleotide. The mammalian cell and in vitro −1 nt selectivity is shown in FIG. 42. Notably, different CDA families are documented as having different −1 nt selectivities, and their selectivities tend to be conserved amongst proteins belonging to the same family. For example, the MG93 family is documented to be selective for T as −1, while the MG139 family is documented to be selective for C as −1. Importantly, the active candidates are documented to have different −1 nt selectivities: 152-6 is selective for T in the −1 position, whereas the 139-52 (WT and engineered variant) has a strong selectivity for C at the −1 position. Having candidates with strong −1 nt selectivities is advantageous, since having a tighter nt selectivity improves off target activity. Candidates with different and strong −1 nt selectivities allow for targeting of different loci with minimal off target activity. Notably, candidates with unusual −1 selectivities were identified. Candidates with purine selectivities include 139-12 and 138-20, with A and G selectivities. These properties may generate variants with G and/or A −1 selectivities with high editing efficiencies.

The candidate 139-52 vas documented as having deaminase activity on both ssDNA and on the DNA strand forming a DNA/RNA heteroduplex (also shown in FIG. 43B). Having exclusive activity in the DNA forming a DNA/RNA heteroduplex may be advantageous in terms of guide-independent off target activity and smaller editing window, as such engineering for this feature is an important venue. When the 139-52-V6 mutant was generated, it was interestingly noted that it abolished the deaminase activity in the DNA/RNA heteroduplex, thus shedding light on the potential importance of this residue for such activity.

The 139-52-V6, 152-6, and 139-52 candidates have high editing efficiencies (FIGS. 41A, 41B, and 41C) and different −1 nt selectivities (FIG. 42). Seeking to characterize them further, how wide their targeting window was in relation to the R-loop formation (spacer targeting) was analyzed. 2 out of the 3 candidates (152-6 and 139-52-V6) show a tighter editing window when compared to the high editing positive control A0A2K5RDN7 (FIG. 44). Having a tighter editing window may help to prevent off-target activities. The engineered candidate 139-52-V6 has a smaller editing window than its WT counterpart (FIG. 44), shedding light on the importance of this mutation. The mutation improved the on-target editing efficiency (FIGS. 41A and 41B), while narrowing the editing window (FIG. 44).

Moreover, the cytotoxicity of all CDA candidates was measured by stably expressing the candidates in mammalian cells through lentiviral transduction. Each CDA candidate was cloned as CBE (using MG3-6 as partner), lentiviruses were produced, and cells were transduced. 3 days post-transduction, cells were selected for viral integration and CBE expression by puromycin selection. The puromycin cassette was downstream of CBEs with a 2A peptide; thus. cells surviving selection expressed the CBEs. Surviving cells were dyed with crystal violet, crystal violet was then solubilized with SDS, and absorbance was taken in a plate reader. It was determined that different CDAs have various levels of cytotoxicity (FIG. 45). The 139-52-V6, 152-6, and 139-52 candidates show a promising cytotoxicity profile under these conditions. It is expected that when the candidates are expressed transiently, this effect may diminish greatly.

Example 35—Using Low Activity CDAs with Nickases with Improved Target Binding Affinity (Prophetic)

Analyzing the editing windows and cytotoxic profiles demonstrated that it may be advantageous to use CDAs with slower deamination kinetics in conjunction with effector enzymes with higher residency time in the targets. In order to create such systems, along form tracr RNA (see e.g. Workman et al. Cell 2021, 184, 675-688, which is incorporated by reference herein in its entirety) is used in the gRNA in con)unction with CDAs with various kinetics (low, medium, and high). These systems may improve on target editing efficiencies of low and medium CDAs, while generating a narrower editing window and a more favorable cytotoxic profile.

Example 36—Adenine Deaminase Engineering (Prophetic)

To improve on-target activity on ssDNA and minimize cellular RNA-unguided deamination, all beneficial mutations previously identified from rational design and directed evolution in the literature were used to design new adenine deaminase (ADA) variants from novel deaminases families (MG129-MG137 and MG68 families, SEQ ID NOs: 1556-1638).

TABLE 12D

Adenosine Deaminase Mutants Designed in Example 36

| SEQ ID NO: | Mutation (relative to background enzyme) | Name in Experiments (numbers before "v" denote background enzyme |
|---|---|---|
| 1556 | A20R, A34L, R46A, E49L, V80S, L82F, C104V, D106N, P107S, A109T, T117N, A120N, D121Y, R144C, F147Y, L150P, Q153V, G154F, K155N | MG131-1v1 |
| 1557 | A12R, A26L, R38A, T41L, V72S, L74F, C96V, D98N, P99S, G101T, A109N, V112N, D113Y, R136C, F139Y, L142P, L145V, G146F, K147N | MG131-2v2 |
| 1558 | A21R, V34L, R46A, A49L, V80S, L82F, C104V, D106N, P107S, A109T, S117N, D121Y, Q144C, F147Y, L150P, Q153V, G154F, K155N | MG131-5v3 |
| 1559 | T43R, A56L, R68A, G71L, V102S, M104F, C126V, D128N, P129S, A131T, R139N, D142N, D143Y, R166C, F169Y, L172P, ins175V | MG131-6v4 |
| 1560 | T36R, R61A, N64L, V95S, M97F, C119V, D121N, P122S, A124T, Q132N, D135N, D136Y, K159C, F162Y, L165P, R168V | MG131-9v5 |
| 1561 | G41R, V54L, R66A, G69L, V100S, M102F, C124V, D126N, P127S, A129T, S137N, E140N, D141Y, R164C, F167Y, L170P, P173V, E174F, A175N | MG131-7v6 |
| 1562 | G19R, R32L, R44A, W47L, V78S, L80F, A102V, D104N, P105S, A107T, A115N, E118N, D119Y, T141C, F144Y, L147P, G150del, R151del, A153F, R154N, G156Q, R157K, P158K, G160Q, E162S, E163I, E164N | MG131-3v7 |
| 1563 | A20R, D33L, R46A, E49L, V80S, L82F, C104V, D106N, P107S, A109R, D117N, R120N, D121Y, Q144C, F147Y, K153V, N154F, R155N | MG134-1v1 |
| 1564 | A19R, R32L, R44A, E47L, V78S, L80F, A102V, D104N, P105S, A107R, E115N, T118N, D119Y, R142C, F145Y, R151V, A152F, K153N | MG134-2v2 |
| 1565 | A25R, R50A, D53L, V84S, L86F, A108V, D110N, A111S, A113R, Q121N, S124N, D125Y, R148C, F151Y, R157V, R158F, R159N | MG134-3v3 |
| 1566 | G19R, R32L, R44A, E47L, V78S, L80F, A102V, D104N, P105S, A107R, Q115N, E118N, D119Y, K142C, F145Y, A148P, R151V, A152F, R153N | MG134-4v4 |
| 1567 | S20R, R33L, P45A, A48L, V79S, V81F, A103V, D105N, P106S, A108T, Q116N, H120Y, Q143C, F146Y, K149P | MG135-1v1 |
| 1568 | L32R, S45L, P57A, A60L, V91S, V93F, A115V, D117N, A118S, A120T, Q128N, H132Y, Q155C, F158Y, R161P, E164V, P165F, D166N | MG135v-2v2 |
| 1569 | L12R, H25L, S37A, D40L, A71S, I73F, A95V, SD97N, P98S, A100T, Q108N, H112Y, Q135C, F138Y, R141P | MG135-4v3 |
| 1570 | L25R, C38L, N50A, D53L, A84S, I86F, A108V, D110N, L111S, A113T, Q121N, H125Y, Q148C, F151Y, R154P | MG135-5v4 |
| 1571 | L44R, H57L, N69A, D72L, V103S, I105F, S127V, D139N, P130S, A132T, P140N, H144Y, Q167C, F170Y, R173P | MG135-6v5 |
| 1572 | L12R, H25L, N37A, E40L, V71S, I73F, A95V, D97N, P98S, A100T, Q108N, H112Y, Q135C, F138Y, R141P | MG135-8v6 |

TABLE 12D-continued

Adenosine Deaminase Mutants Designed in Example 36

| SEQ ID NO: | Mutation (relative to background enzyme) | Name in Experiments (numbers before "v" denote background enzyme |
|---|---|---|
| 1573 | A20R, C33L, N45A, D48L, V79S, I81F, A103V, D105N, P106S, A108T, T116N, H120Y, R143C, F146Y, K149P | MG135-7v7 |
| 1574 | Q20R, C33L, N45A, D48L, V79S, I81F, A103V, D105N, P106S, A108T, G116N, H120Y, Q143C, F146Y, K149P | MG135-3v8 |
| 1575 | E30R, S43L, P55A, V80S, T114V, E116N, P117S, A119R, Q127N, K130N, N131Y, S155C, F158Y, R161P | MG137-1v1 |
| 1576 | A30R, M43L, P55A, V89S, T113V, E115N, P116S, A118R, Q126N, Q129N, D130Y, Q153C, F156Y, R159P, K173I, E174N | MG137-2v2 |
| 1577 | A23R, R36L, P48A, V82S, A106V, E108N, P109S, A111R, C119N, D122N, E123Y, S146C, F149Y, R152P, K166I, E167N | MG137-4v3 |
| 1578 | A23R, P48A, V82S, A106V, E108N, P109S, A111R, R119N, E122N, E123Y, S146C, F149Y, R152P, K166I, E167N | MG137-6v4 |
| 1579 | A22R, P47A, V81S, A105V, E107N, P108S, A110R, R118N, D121N, E122Y, S145C, F148Y, R151P, K166I, E167N | MG137-17v5 |
| 1580 | A28R, R41L, P53A, V87S, A111V, E113N, P114S, A116R, S124N, D127N, E128Y, S151C, F154Y, R157P, S172I, E173N | MG137-9v6 |
| 1581 | E12R, P37A, V71S, A95V, E97N, P98S, S100R, R108N, D111N, A112Y, S135C, F138Y, R141P, R156I, E157N | MG137-11v7 |
| 1582 | A29R, R42L, P54A, V88S, A112V, E114N, P115S, A117R, R125N, D128N, A129Y, Q152C, F155Y, R158P | MG137-12v8 |
| 1583 | A20R, P45A, V79S, T103V, E105N, P106S, R116N, D119N, T120Y, S144C, F147Y, P150R | MG137-13v9 |
| 1584 | A22R, R35L, V47A, V81S, A105V, E107N, P108S, A110R, A118N, D121N, Q122Y, Q145C, F148Y, R151P | MG137-15v10 |
| 1585 | A27R, R40L, P52A, V86S, T110V, E112N, P113S, A115R, R123N, E126N, Q127Y, S150C, F153Y, R156P | MG137-5v11 |
| 1586 | A29R, R42L, P54A, V88S, A112V, E114N, P115S, A117R, R125N, E128N, Q129Y, Q152C, F155Y, R158P | MG137-14v12 |
| 1587 | A21R, R34L, P46A, V80S, A104V, E106N, P107S, Y109R, R117N, D120N, S121Y, R144C, F147Y, R150P | MG137-16v13 |
| 1588 | A26R, P51A, V85S, A109V, E111N, P112S, S114R, K122N, D125N, N126Y, S149C, F152Y, R155P, G167I, P168N | MG137-8v14 |
| 1589 | F20R, A34L, P46A, V80S, A104V, E106N, P107S, T109R, A120N, Q121Y, K144C, F147Y, K150P | MG137-3v15 |
| 1590 | K21R, G34L, V46A, V80S, L82F, A104V, D106N, P107S, A109R, Q117N, T120N, L121Y, T144C, F147Y, K150P, A153V, K154F, H155N | MG68-55v1 |
| 1591 | W21R, G35L, S47A, V81S, L83F, A105V, D107N, P108S, N110R, P120N, L121Y, K144C, F147Y, R150P, E153V, T154F, E163I, E164N | MG68-27v2 |
| 1592 | Y12R, A26L, S38A, D41L, V72S, L74F, A96V, D98N, L99S, T101R, S112N, D113Y, S136C, F139Y, R142P, Q145V, K146F, K147N | MG68-52v3 |
| 1593 | Y22R, S36L, P48A, S51L, V82S, L84F, A106V, D108N, P109S, T111R, D119N, S122N, V123Y, R146C, F149Y, R152P, E155V, G156F, K157N, R167I, P168N | MG68-15v4 |

TABLE 12D-continued

Adenosine Deaminase Mutants Designed in Example 36

| SEQ ID NO: | Mutation (relative to background enzyme) | Name in Experiments (numbers before "v" denote background enzyme |
|---|---|---|
| 1594 | Y22R, S36L, T48A, D51L, V82S, L84F, A106V, D108N, P109S, T111R, C119N, A122N, N123Y, R146C, F149Y, R152P, G155V, S156F, K157N | MG68-58v5 |
| 1595 | A18R, I31L, P43A, T46L, V77S, L79F, A101V, D103N, P104S, A106R, D114N, S118N, D119Y, R142C, F145Y, K148P, S151V, P152F, R153N, D167I, N168N | MG68-25v6 |
| 1596 | G47R, G60L, P72A, V106S, L108F, A130V, D132N, P133S, T135R, A143N, T146N, D147Y, K170C, F173Y, R176P, H179V, S180F, P181N, T190I, P191N | MG68-18v7 |
| 1597 | Y26R, E40L, T52A, D55L, V86S, L88F, A110V, D112N, L113S, T115R, D127Y, S150C, F153Y, R156P, M159V, Q160F, K161N, K179I, D180N | MG68-45v8 |
| 1598 | W40R, H53L, P65A, D68L, V99S, L101F, A123V, D125N, P126S, T128R, D136N, A139N, Q140Y, Q163C, F166Y, R169P, R172V, A173F, R174N, D204A, E205N | MG68-13v9 |
| 1599 | W24R, R37L, S52L, V83S, L85F, A107B, D109N, P110S, T112R, D120N, R123N, H124Y, S147C, F150Y, R153P, G166I | MG68-4v10 |
| 1600 | F23R, H36L, R49A, V83S, L85F, A107V, D109N, A110S, A112R, E120N, D124Y, G147C, F150Y, K153P | MG132-1v1 |
| 1601 | D35R, S48L, R61A, V95S, L97F, C119V, D121N, P122S, A124R, Q132N, S135N, D136Y, S159C, F162Y, K165P | MG132-1v2 |
| 1602 | L12R, H25L, R39A, D42L, V73S, L75F, C97V, D99N, P100S, A102R, Q110N, S113N, D114Y, T137C, F140Y, K143P | MG132-1v3 |
| 1603 | L25R, R38L, R50A, D53L, V84S, L86F, A108V, D110N, G121N, A124N, D125Y, R149C, L155P, R158V, G159F, D160N | MG133-1v1 |
| 1604 | A13R, Q28L, R40A, D43L, V74S, L76F, A98V, D100N, E111N, S114N, D115Y, R138C, L144P | MG133-2v2 |
| 1605 | A37R, E52L, R64A, D67L, V98S, L100F, A122V, D124N, E135N, D138N, D139Y, R162C, L168P | MG133-7v3 |
| 1606 | A28R, Q43L, R55A, H58L, V89S, L91F, A113V, D115N, E126N, D129N, D130Y, R153C, L159P, Q162V, R163F, K164N | MG133-4v4 |
| 1607 | E27R, E42L, R54A, D57L, V88S, L90F, A112V, D114N, A125N, S128N, D129Y, R152C, R158P | MG133-12v5 |
| 1608 | A43R, G58L, R70A, D73L, V104S, L106F, A128V, D130N, R141N, S144N, D145Y, K168C, L174P, G177V, G178F, R179N | MG133-5v6 |
| 1609 | M25R, A40L, R52A, D55L, V86S, L88F, A110V, D112N, R123N, Q126N, D127Y, R150C, K156P, R159V, T160F, D161N | MG133-9v7 |
| 1610 | G36R, A51L, R63A, D66L, V97S, L99F, A121V, D123N, A134N, Q137N, D138Y, R161C, R167P | MG133-14v8 |
| 1611 | A24R, S39L, R51A, D54L, V85S, L87F, A109V, D111N, G122N, T125N, D126Y, S149C, R155P, A158V, D159F, K160N | MG133-8v9 |
| 1612 | A13R, C26L, R38A, D41L, V72S, L74F, A96V, D98N, Q109N, S112N, E113Y, K136C, R142P, G145V, G146F | MG133-10v10 |
| 1613 | A41R, H54L, R66A, E69L, V100S, L102F, A124V, D126N, Q137N, S140N, D141Y, R164C, L170P, R173V, R174F, R175N | MG133-13v11 |
| 1614 | A33R, K46L, R58A, A60L, V92S, L94F, A116V, D118N, E129N, I132N, D133Y, R156C, R162P, I165V, N166F, R167N | MG133-3v12 |
| 1615 | A33R, R46L, R58A, N61L, V92S, L94F, A116V, D118N, E129N, S132N, D133Y, K156C, R162P, I165V, N166F, R167N | MG133-6v13 |
| 1616 | S22R, R35L, R47A, W50L, V81S, L83F, I105V, D107N, R118N, D121N, T122Y, Q154C, R151P, K154V, D155F, K156N | MG133-11v14 |
| 1617 | E31R, I44L, P56A, R59L, L92F, A114V, D116N, I117S, F119R, R127N, D130N, S131Y, R154C, L157Y, A160P | MG136-1v1 |
| 1618 | E18R, I31L, P43A, L79F, A101V, D103N, L104S, F106R, R114N, D117N, S118Y, K141C, F144Y, R147P | MG136-6v2 |
| 1619 | A27R, A41L, P53A, M56L, V87S, L89F, A111V, D113N, L114S, F116R, R124N, D127N, S128Y, E151C, F154Y, R157P | MG136-12v3 |
| 1620 | G12R, A25L, T37A, D40L, I72F, A94V, D96N, E97S, A99R, R107N, D110N, T111Y, Q134C, F137Y, R140P | MG136-2v4 |
| 1621 | D38L, T50A, D53L, I86F, A108V, D110N, E111S, A113R, S121N, T125Y, Q148C, F151Y, R154P | MG136-3v5 |
| 1622 | A22R, A36L, P48A, N51L, I84F, S106V, D108N, E109S, F111R, R119N, D122N, S123Y, Q146C, F149Y, R152P | MG136-9v6 |
| 1623 | E20R, A34L, T46A, A49L, T80S, I82F, A104V, D106N, E107S, F109R, D120N, N121Y, Q144C, F147Y, K150P, F153V, Q154F, K155N | MG136-10v7 |
| 1624 | E12R, G26L, T38A, D41L, I74F, A96V, D98N, E99S, F101R, K109N, S112N, G113Y, T135C, R141P | MG136-11v8 |
| 1625 | S23R, Y37L, R51A, D54L, V85S, L87F, A109V, D111N, P112S, A114R, D122N, R149C, F152Y, L155P | MG129-1v1 |
| 1626 | E18R, H31L, R43A, D46L, V77S, L79F, A101V, D103N, P104S, A106R, E117N, E118Y, K141C, F144Y, L147P | MG129-2v2 |
| 1627 | G21R, F34L, R46A, D49L, V80S, L82F, T104V, D106N, P107S, A109R, E120N, E121Y, S144C, F147Y, L150P | MG129-11v3 |
| 1628 | A22R, H35L, R47A, D50L, V81S, L83F, A105V, D107N, P108S, A110R, D118N, S121N, D122Y, R145C, F148Y, R151P | MG129-3v4 |
| 1629 | A25R, R50A, D53L, V84S, L86F, A108V, D110N, P111S, A113R, D121N, A124N, D125Y, R148C, F151Y, R154P | MG129-7v5 |
| 1630 | G12R, R37A, G40L, V71S, L73F, A95V, D97N, P98S, A100R, D108N, Q111N, D112Y, R135C, F138Y, R141P | MG129-4v6 |
| 1631 | A20R, F33L, R45A, A48L, V79S, L81F, A103V, D105N, P105S, A108R, A116N, T119N, D120Y, K143C, F146Y, K149P | MG129-9v7 |
| 1632 | A12R, R25L, R37A, D40L, V71S, L73F, C95V, D97N, P98S, G100R, D108N, Q111N, V112Y, K135C, F138Y, L141P | MG129-10v8 |
| 1633 | G15R, S28L, R40A, D43L, V74S, L76F, A98V, D100N, A101S, Q103R, G111N, K132C, F135Y, L138P | MG129-12v9 |
| 1634 | A19R, H32L, R46A, D49L, V80S, L82F, P107S, Q117N, D121Y, K144C, V147Y, Q150P, L153V, G154F, K155N | MG130-3v1 |
| 1635 | G32R, H45L, R57A, D60L, V90S, Q92F, C114V, P117S, A119R, Q127N, T130N, D131Y, F157Y, L160P, G163V, P164F, E165N | MG130-1v2 |
| 1636 | A59R, A92L, R105A, D108L, V138S, Q140F, C162V, P165S, A167R, S175N, S178N, D179Y, F205Y, L208P, G211V, P212F, T213N | MG130-5v3 |

TABLE 12D-continued

| Adenosine Deaminase Mutants Designed in Example 36 | | |
|---|---|---|
| SEQ ID NO: | Mutation (relative to background enzyme) | Name in Experiments (numbers before "v" denote background enzyme |
| 1637 | G36R, I49L, R61A, S64L, V94S, Q96F, C118V, P121S, A123R, E131N, T134N, D135Y, F161Y, L164P, N167V, G168F, R169N | MG130-2v4 |
| 1638 | L18R, H31L, R45A, A48L, V79S, L81F, C103V, D105N, P106S, A108R, E119N, D120Y, V145Y, R158P, S161V, T162F, T163N | MG130-4v5 |

In Vitro Activity of Novel ADA Variants from MG129-MG137 and MG68 Families

In Vitro Deaminase in-Gel Assay

Linear templates for candidate deaminases are amplified using plasmids from TWIST via PCR. Products are cleaned using SPRI beads (Lucigen) and eluted in 10 mM tris. Enzymes are then expressed in PURExpress(NEB) at 37° C. for 2 hours. Deamination reactions are prepared by mixing PURExpress reactions (2 μL) with a 10 μM DNA substrate (IDT, SEQ ID NO: 1645) labeled with Cy5.5, 1 U EndoV (NEB), and 10×NEB4 Buffer. Reactions are incubated at 37° C. for 20 hours. Samples are quenched by adding 4 units of proteinase K (NEB) and incubated at 55° C. for 10 minutes. The reaction is further treated by addition of 11 μL of 2× RNA loading dye and incubated at 75° C. for 10 minutes. All reaction conditions are analyzed by gel electrophoresis in a 10% (TBE-urea) denaturing gel (Biorad). DNA bands are visualized by a Chemi-Doc™ imager (Biorad) and band intensities are quantified using BioRad Image Lab™ v6.0. Successful deamination is observed by the visualization of an intermediate fluorescently labeled band in the gel.

In Vitro NGS-Based Screening for In Vitro Deamination

Linear templates for candidate deaminases are amplified using plasmids from TWIST via PCR. Products are cleaned using SPRI beads (Lucigen) and eluted in 10 nM tris. Enzymes are then expressed in PURExpress(NEB) at 37° C. for 2 hours. Deamination reactions are prepared by mixing PURExpress reactions (2 μL) with a 250 nM single-stranded DNA substrate (IDT, SEQ ID NO: 1646) and 1 U of NEB4 buffer. Reactions are incubated at 37° C. for 2 hours. Reactions are quenched by incubating at 95° C. for 10 minutes, adding 90 μL of water at 95° C., and placing on ice for 2 minutes. 1 μL of digest reaction is used per PCR reaction (oligos IDT). Reactions are then cleaned using column purification (Zyno), eluted in 10 mM tris, and sequenced.

Example 37—Engineering of ABE Using nMG34-1 (D10A) Nickase

Plasmid Construction

DNA fragments of genes were either synthesized at Twist Bioscience or Integrated DNA Technologies (IDT). Plasmid DNA was amplified in Endura electrocompetent cells (Lucigen) and isolated by QIAprep Spin Miniprep Kit (Qiagen). Vector backbones were prepared by restriction enzyme digestion of plasmids. Inserts were amplified by Q5® High-Fidelity DNA polymerase (New England Biolabs) using primers ordered either from Elim BIOPHARM or IDT. Both vector backbones and inserts were purified by gel extraction using the Gel DNA Recovery Kit (Zymo Research). One or multiple DNA fragments were assembled into the vectors through NEBuilder® HiFi DNA assembly (New England Biolabs). The plasmid sequence used for expression of nMG34-1 (D10A) adenine base editor and sgRNA are shown in SEQ ID NO: 1422.

Cell Culture, Transfections, Next Generation Sequencing, and Base Edit Analysis

HEK293T cells were grown and passaged in Dulbecco's Modified Eagle's Medium plus GlutaMAX™ (gibco) supplemented with 10% (v/v) fetal bovine serum (gibco) at 37° C. with 5% $CO_2$. $2.5\times10^4$ cells (passage 3-8) were seeded on 96-well cell culture plates treated for cell attachment (Costar), grown for 20 to 24 h, and the spent media were refreshed with new media right before transfection. For the dual plasmid system, 300 ng expression plasmid along with 100 ng guide plasmid were transfected using 1 μL Lipofectamine™ 2000 (ThermoFisher Scientific) per well according to the manufacturer's instructions. For the single plasmid system, 300 ng plasmid carrying the base editor gene and guide RNA was transfected using 1 μL Lipofectamine™. Transfected cells were grown for 3 days, harvested, and gDNA was extracted with QuickExtract (Lucigen) according to the manufacturer's instructions. Targeted regions for base edits were amplified using Q5® High-Fidelity DNA polymerase (New England Biolabs) with primers and extracted DNA as the templates. PCR products were purified by HighPrep PCR Clean-up System (MAGBIO) according to the manufacturer's instructions. After 72 hours, individual wells were visually assessed for cell viability based on cell growth and presence of floating cells in media. Following the visual assessment of cell viability, cells were harvested and genomic DNA was extracted. PCR primers appropriate for use in NGS-based DNA sequencing were generated, optimized, and used to amplify the individual target sequences for each guide RNA. The amplicons were sequenced on an Illumina MiSeq machine and analyzed with a proprietary Python script to measure gene editing.

Results

MG68-4 is predicted to be a tRNA adenosine deaminase. As the natural enzymes of *E. coli* TadA (EcTadA) and *S. aureus* TadA (SaTadA) are both dimers, MG68-4 was suspected be a dimer as well. It has been shown that using a protein fusion of engineered EcTadA homodimer can increase the editing efficiency (Gaudelli, N. M. et al. Programmable base editing of AT to GC in genomic DNA without DNA cleavage. Nature 2017, 551, 464-471). As such, a series of MG68-4 (D109N) homodimers was designed and fused with nMG34-1 (D10A). To design the linkers between two monomers, the length between the N-terminus of the first monomer and the C-terminus of the second monomer was estimated using Visual Molecular Dynamics (VMD) (Humphrey, W. et al. VMD—Visual Molecular Dynamics, *J Mol. Graph.* 1996, 14, 33-38), and the model suggested 5.2 nm (FIG. 46A). The fusions were optimized by varying linker lengths ranging from 32 to 64 amino acids, and a negative control with 5 amino acids was included (SEQ ID NOs: 1356-1362). The result indicated that the best linker length was 64 amino acids, which might provide enough flexibility to accommodate the distance between monomers. With this optimized linker, an increase of 87% editing was obtained compared to the monomeric design of MG68-4 fused with nMG34-1 (D109N) (FIG. 46B).

Previously, MG68-4 (D109N)-nMG34-1 (D10A) was observed to have C to G edit on the sixth position when using guide 633 (SEQ ID NO: 1416). To reduce the promiscuous activity toward cytosine, the approach that was used by Jeong (Jeong, Y. K. et al. Adenine base editor engineering reduces editing of bystander cytosines. Nat. Biotechnol. 2021, 39, 1426-1433) was applied, where Q was installed at D108 position in EcTadA. By incorporating Q into the D109 position of MG68-4, the ABE showed 64% reduction of C to G edit on C6 position using guide 633 while maintaining comparable A to G edit on A8 position using guide 634 (SEQ ID NO: 1417). To increase editing efficiency, two beneficial mutations (H129N and D7G/E10G) were incorporated along with D109Q. The results showed that the editing efficiencies of new mutants were reduced, suggesting incompatibility of mutations (SEQ ID NOs: 1639-1644) (FIG. 47).

Example 38—Engineering of ABE Using nMG3-6/3-8 (D13A) Nickase

Plasmid Construction

DNA fragments of genes were either synthesized at Twist Bioscience or Integrated DNA Technologies (IDT). Plasmid DNA was amplified in Endura electrocompetent cells (Lucigen) and isolated by QIAprep Spin Miniprep Kit (Qiagen). Vector backbones were prepared by restriction enzyme digestion of plasmids. Inserts were amplified by Q5® High-Fidelity DNA polymerase (New England Biolabs) using primers ordered either from Elim BIOPHARM or IDT. Both vector backbones and inserts were purified by gel extraction using the Gel DNA Recovery Kit (Zymo Research). One or multiple DNA fragments were assembled into the vectors through NEBuilder® HiFi DNA assembly (New England Biolabs). The plasmid sequences used for expression of the nMG3-6/3-8 adenine base editor and sgRNA are shown in SEQ ID NO: 1423.

Cell Culture, Transfections, Next Generation Sequencing, and Base Edit Analysis

HEK293T cells were grown and passaged in Dulbecco's Modified Eagle's Medium plus GlutaMAX™ (gibco) supplemented with 10% (v/v) fetal bovine serum (gibco) at 37° C. with 5% $CO_2$. $2.5\times10^4$ cells (passage 3-8) were seeded on 96-well cell culture plates treated for cell attachment (Costar), grown for 20 to 24 h, and the spent media were refreshed with new media right before transfection. For the dual plasmid system, 300 ng expression plasmid along with 100 ng guide plasmid were transfected using 1 μL Lipofectamine™ 2000 (ThermoFisher Scientific) per well according to the manufacturer's instructions. For the single plasmid system, 300 ng plasmid carrying the base editor gene and guide RNA was transfected using 1 μL Lipofectamine™. Transfected cells were grown for 3 days, harvested, and gDNA was extracted with QuickExtract (Lucigen) according to the manufacturer's instructions. Targeted regions for base edits were amplified using Q5® High-Fidelity DNA polymerase (New England Biolabs) with primers and extracted DNA as the templates. PCR products were purified by HighPrep PCR Clean-up System (MAGBIO) according to the manufacturer's instructions. After 72 hours, individual wells were visually assessed for cell viability based on cell growth and presence of floating cells in media. Following the visual assessment of cell viability, cells were harvested and genomic DNA extracted. PCR primers appropriate for use in NGS-based DNA sequencing were generated, optimized, and used to amplify the individual target sequences for each guide RNA. The amplicons were sequenced on an Illumina MiSeq machine and analyzed with a proprietary Python script to measure gene editing.

Results

Through directed evolution of the predicted tRNA adenosine deaminase of MG68-4 (D109N)-nMG34-1 (D10A) in *E. coli*, two mutants (D109N/D7G/E10G and D109N/H129N) were observed to outperform the D109N mutant for higher editing A to G efficiency in HEK293T cells. Through rational design based on the reported mutations of EcTadA (Gaudelli, N. M. et al. Programmable base editing of AT to GC in genomic DNA without DNA cleavage. Nature 2017, 551, 464-471; Gaudelli N. M. et al. Directed evolution of adenine base editors with increased activity and therapeutic application. *Nat. Biotechnol.* 2020, 38, 892-900; and Richter M. F. et al. Phage-assisted evolution of an adenine base editor with improved Cas domain compatibility and activity. *Nat. Biotechnol.* 2020, 38, 883-891) for MG68-4, five mutants (V83S, L85F, T112R, D148R, and A155R) fused with nMG34-1 (D10A) were observed to be beneficial on top of D109N mutation. All identified mutations were combined, and a combinatorial library was designed to interrogate enzymatic performance of the adenosine deaminase (Table 13) (SEQ ID NOs: 1363-1409).

TABLE 13

Mutations installed in the combinatorial library of MG68-4. All Mg68-4 variants are inserted into 3-68_DIV30_M_RDr1v1_B

| Variant | Mutation |
|---|---|
| CL1 | WT |
| CL2 | D109N |
| CL3 | D7G/E10G/D109N |
| CL4 | V83S/D109N |
| CL5 | L85F/D109N |
| CL6 | D109N/T112R |
| CL7 | D109N/H129N |
| CL9 | D109N/A155R |
| CL10 | D7G/E10G/V83S/D109N |
| CL11 | D7G/E10G/L85F/D109N |
| CL12 | D7G/E10G/T112R/D109N |
| CL13 | D7G/E10G/H129N/D109N |
| CL14 | D7G/E10G/D148R/D109N |
| CL15 | D7G/E10G/A155R/D109N |
| CL16 | V83S/L85F/D109N |
| CL17 | V83S/D109N/T112R |
| CL18 | V83S/D109N/H129N |
| CL20 | V83S//D109N/A155R |
| CL22 | L85F/D109N/T112R |
| CL23 | L85F/D109N/H129N |
| CL25 | L85F/D109N/A155R |
| CL28 | D109N/T112R/H129N |
| CL29 | D109N/T112R/D148R |
| CL30 | D109N/T112R/A155R |
| CL34 | D109N/H129N/D148R |
| CL35 | D109N/H129N/A155R |
| CL40 | D109N/D148R/A155R |
| CL56 | V83S/L85F/D109N/T112R |
| CL57 | V83S/L85F/D109N/H129N |
| CL58 | V83S/D109N/T112R/H129N |
| CL59 | V83S/L85F/D109N/H129N |
| CL60 | V83S/L85F/D109N/T112R/H129N |
| CL61 | D7G/E10G/V83S/L85F/D109N/T112R/H129N/D148R/A155R |
| CL62 | E10G/V83S/L85F/D109N/T112R/H129N/D148R/A155R |
| CL63 | D7G/V83S/L85F/D109N/T112R/H129N/D148R/A155R |
| CL64 | D7G/E10G/L85F/D109N/T112R/H129N/D148R/A155R |
| CL65 | D7G/E10G/V83S/D109N/T112R/H129N/D148R/A155R |
| CL66 | D7G/E10G/V83S/L85F/D109N/H129N/D148R/A155R |

TABLE 13-continued

Mutations installed in the combinatorial library of MG68-4. All Mg68-4 variants are inserted into 3-68_DIV30_M_RDr1v1_B

| Variant | Mutation |
| --- | --- |
| CL67 | D7G/E10G/V83S/L85F/D109N/T112R/D148R/A155R |
| CL68 | D7G/E10G/V83S/L85F/D109N/T112R/H129N/A155R |
| CL69 | D7G/E10G/V83S/L85F/D109N/T112R/H129N/D148R |
| CL70 | L85F/D109N/T112R/H129N/D148R/A155R |
| CL71 | V83S/D109N/T112R/H129N/D148R/A155R |
| CL72 | V83S/L85F/D109N/H129N/D148R/A155R |
| CL73 | V83S/L85F/D109N/T112R/D148R/A155R |
| CL74 | V83S/L85F/D109N/T112R/H129N/A155R |
| CL75 | V83S/L85F/D109N/T112R/H129N/D148R |

All variants were inserted into 3-68_DIV30_M nickase chassis, where 3-68, DIV, and M stood for MG3-6/3-8 nickase, domain inlaid version 30, and monomer, respectively. The screening of the resulting ABEs revealed that 27 variants outperformed CL2 (MG68-4 (D109M)). The highest editing efficiency was observed when V83S/L85F/D109N were combined together, and the effect of improving editing was supported by increased activities of V83S/D109N and L85F/D109N observed in CL4 and CL5, respectively. In addition to CL16, CL22 also demonstrated high editing efficiency. In this variant, the mutation of V83S was replaced by T112R in the V83S/L85F/D109N triple mutant (FIG. 48).

In order to increase A to G base editing percentage of the 3-68_DIV30_M adenine base editor, a 3-68_DIV30_D ABE was designed in which two MG68-4 (D109N) monomers are connected by a 65AA linker and inlaid within the 3-68 scaffold at the same V30 insertion site as 3-68_DIV30 M (SEQ ID NOs: 1410-1411). This dimeric form of the 3-68 ABE increased editing at position A10 of a site within the TRAC gene when co-transfected with a plasmid expressing sgRNA68 (SEQ ID NO: 1421) from 8% (3-68_DIV30_M) to 18% (3-68_DIV30_D) sgRNA68. The influence of two different MG68-4 variants (H129N or D7G/E10G) was also tested on 3-68_DIV30_M and 3-68_DIV30_D already containing D109N (SEQ ID NOs: 1412-1415). For 3-68_DIV30_D, the H129N or D7G/E10G mutation was installed within the second MG68-4 D109N, and the first deaminase remained MG68-4 D109N. The H129N and D7G/E10G variants were identified using an error-prone PCR library of MG68-4 fused to MG34-1 and selecting for A to G conversion in *E. Coli*. After addition of either the H129N or D7G/E10G variants, in both the monomeric and dimeric MG68-4 D109N, editing was slightly lower as compared to the 3-68_DIV30 MG68-4 D109N ABE in the equivalent monomeric/dimeric form (FIG. 49).

Example 39—Engineering of nMG35-1 as a Base Editor

*E. coli* Selection

A nickase MG35-1 containing a D59A mutation with a C-terminally fused TadA*-(7.10) monomer along with a C-terminus SV40 NLS was constructed to test MG35-1 adenine base editor (ABE) activity (SEQ ID NOs: 1424-1426). This ABE was tested with its compatible sgRNA containing either a 20 nucleotide spacer sequence targeting the chloramphenicol acetyltransferase (CAT) gene or a non-targeting spacer sequence of the same 20 nucleotides in a scrambled order (SEQ ID NOs: 1429-1430). The CAT gene contains a H193Y mutation that renders the CAT gene nonfunctional against chloramphenicol selection. The ABE, sgRNA, and non-functional CAT gene were cloned into a pET-21 backbone containing Ampicillin resistance. For both constructs, 10 ng of the plasmid was transformed into 25 μL of BL21(DE3) (Lucigen) *E. Coli* cells and the cells were left shaking at 37° C. in 450 μL of recovery media for 90 minutes. Next, 70 μL of recovery media containing transformed cells was plated onto plates containing chloramphenicol concentrations of 0, 2, 3, 4, and 8 μg/mL. The 0 μg/mL plate was used as a transformation control. Plates also contained 100 μg/mL Carbecillin and 0.1 mM IPTG. Plates were left at 37° C. for 40 hours. Colonies were sequenced by Elim Biopharmaceuticals, Inc.

Results

In order to determine whether the SMART II enzymes can be used as base editors, an adenine base editor (ABE) was constructed by fusing a TadA*-(7.10) monomer to the C-terminus of a nickase form of MG35-1 containing a D59A mutation (SEQ ID NO: 1424). The A to G editing of this ABE was tested in a positive selection single-plasmid *E. Coli* system in which the ABE is required to revert a chloramphenicol acetyltransferase (CAT) gene containing a Y193 mutation back to H193 in order for the *E. Coli* cell to survive chloramphenicol selection. This plasmid contained an sgRNA with a spacer either targeting the mutant CAT gene or a scrambled, non-targeting spacer region. An enrichment of colonies was detected with *E. Coli* transformed with the MG35-1 ABE targeting the CAT gene when plated on plates containing 2, 3, and 4 μg/mL of chloramphenicol, while no colonies grew on the plate containing 8 μg/mL of chloramphenicol. Sanger sequencing confirmed that 26/30 colonies picked from the 2, 3, and 4 μg/mL plates transformed with the targeting MG35-1 ABE contained the expected Y193H reversion. It is likely that the 4 colonies without the reverted CAT sequence contain more unedited than edited copies of the selection construct as one reverted CAT gene is sufficient to confer colony survival. No colonies were seen on the 2, 3, 4, and 8 μg/mL plates plated with *E. Coli* transformed with the non-targeting MG35-1 ABE. While the 0 μg/mL condition was used as a transformation control, Sanger sequencing found that 1/10 colonies picked from the 0 μg/mL plate transformed with the targeting MG35-1 ABE contained the Y193H reversion, indicating a detectable level of editing even without chloramphenicol selection. The colony growth enrichment from chloramphenicol selection of the targeting MG35-1 ABE condition from the CAT gene Y193H reversion confirms that the MG35-1 nickase can function as an ABE in *E. Coli* cells (FIG. 50).

Example 40—Guide Screening for the nMG3-6/3-8 ABE in Mouse Hepatocytes

Cell Culture, Transfections, Next Generation Sequencing, and Base Edit Analysis for Screens Hepa1-6 cells were grown and passaged in Dulbecco's Modified Eagle's Medium plus 1×NEAA (gibco) supplemented with 10% (v/v) fetal bovine serum (gibco) and 1% pen-strep at 37° C. with 5% $CO_2$. $1\times10^5$ cells were nucleofected with 500 ng IVT mRNA and 150 pmol chemically-synthesized sgRNA (IDT) using a Lonza-4D Nucleofector® (program EH-100). Cells were grown for 3 days, harvested, and gDNA was extracted with QuickExtract (Lucigen) according to the manufacturer's instructions. Targeted regions for base edits were amplified using Q5® High-Fidelity DNA polymerase (New England Biolabs) with primers appropriate for use with NGS-based DNA sequencing (SEQ ID NOs: 1493-1554) and extracted DNA as the templates. PCR products were purified by HighPrep PCR Clean-up System (MAGBIO) according to the manufacturer's instructions. Amplicons were sequenced on an Illumina MiSeq machine and analyzed with a proprietary Python script to measure gene editing.

mRNA Production

Sequences for base editor mRNA were codon optimized for human expression (GeneArt), then synthesized and cloned into a high copy ampicillin plasmid (Twist Biosciences). Synthesized constructs encoding T7 promoter, UTRs, base editor ORF, and NLS sequences were digested from the Twist backbone with HindII and BamHI (NEB), and ligated into a pUC19 plasmid backbone (SEQ ID NO: 1555) with T4 DNA ligase and 1× reaction buffer (NEB). The complete base editor mRNA plasmid comprised an origin of replication, ampicillin resistance cassette, the synthesized construct, and an encoded polyA tail. Base editor mRNA was synthesized via in vitro transcription (IVT) using the linearized base editor mRNA plasmid. This plasmid was linearized by incubation at 37° C. for 16 hours with SapI (NEB) enzyme. The linearization reaction comprised a 50 μL reaction containing 10 μg pDNA, 50 units Sap I, and 1× reaction buffer. The linearized plasmid was purified with Phenol:Chloroform:Isoamyl Alcohol (25:24:1, v/v), precipitated in EtOH, and resuspended in nuclease-free water at an adjusted concentration of 500 ng/μL. The IVT reaction to generate base editor mRNA was performed at 50° C. for 1 hr under the following conditions: 1 μg linearized plasmid; 5 mM ATP, CTP, GTP (NEB), and Nl-methyl pseudo-UTP (TriLink); 18750 U/mL Hi-T7 RNA Polymerase (NEB); 4 mM CleanCap AG (TriLink); 2.5 U/mL Inorganic *E. coli* pyrophosphatase (NEB); 1000 U/mL murine RNase Inhibitor (NEB); and 1× transcription buffer. After 1 hr, IVT was stopped, and plasmid DNA was digested with the addition of 250 U/mL DnaseI (NEB) and incubated for 10 min at 37° C. Purification of base editor mRNA was performed using an Rneasy Maxi Kit (Qiagen) using the standard manufacturer's protocol. Transcript concentration was determined by UV (NanoDrop) and further analyzed by capillary gel electrophoresis on a Fragment Analyzer (Agilent).

Results

To test the activity of the engineered dimeric form of the 3-68 ABE described above, 527 MG3-6/3-8 chemically-synthesized guides targeting four therapeutically relevant loci in the mouse genome were designed and purchased from IDT. These guides were co-transfected with in vitro synthesized mRNA in Hepa1-6 (a mouse immortalized mouse hepatocyte cell line) via nucleofection, and A to G conversion was assayed three days post-nucleofection. Guides were rank-ordered by percent total deamination within the spacer region, and deeper analysis of active guides was restricted to guides with >80% in-spacer deamination and with high number of NGS reads. Altogether, total spacer A to G deamination above 1000 was observed at 31 distinct guides across three loci (SEQ ID NOs: 1431-1492; FIGS. 51-53) with two guides showing conversion rates of 89% and 95% (Apoa1 D11 and Apoa1 F12, respectively).

TABLE 13A

Guide sequences used in Example 40

| SEQ ID NO: | sgRNA name | Sequence |
|---|---|---|
| 1431 | MG3-6/3-8 mApoa1 BE F12 | mC*mU*mG*rGrUrGrUrGrGrUrArCrUrCrGrUrUrCrArArGrG rGrUrUrGrArGrArArUrCrGrArArArGrArUrUrCrUrUrArArUr ArArGrGrCrArUrCrCrUrUrCrCrGrArUrGrCrUrGrArCrUrUrCr UrCrArCrCrGrUrCrCrGrUrUrUrUrCrCrArArUrArGrGrArGrCr GrGrGrCrGrGrUrArUrGrU*mU*mU*mU |
| 1432 | MG3-6/3-8 mApoa1 BE D11 | mA*mC*mU*rArUrGrGrCrGrCrArGrGrUrCrCrUrCrCrArGrCr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrUrCrCrArArUrArGrGrArGrCrG rGrGrCrGrGrUrArUrGrU*mU*mU*mU |
| 1433 | MG3-6/3-8 mApoa1 BE C5 | mU*mU*mG*rGrGrUrGrArGrArCrArGrGrArGrArUrGrArArC rGrUrUrGrArGrArArUrCrGrArArArGrArUrUrCrUrUrArArUr ArArGrGrCrArUrCrCrUrUrCrCrGrArUrGrCrUrGrArCrUrUrCr UrCrArCrCrGrUrCrCrGrUrUrUrUrCrCrArArUrArGrGrArGrCr GrGrGrCrGrGrUrArUrGrU*mU*mU*mU |
| 1434 | MG3-6/3-8 mApoa1 BE A4 | mU*mC*mU*rCrCrUrGrGrArArArArCrUrGrGrGrArCrArCrUr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrUrCrCrArArUrArGrGrArGrCrG rGrGrCrGrGrUrArUrGrU*mU*mU*mU |
| 1435 | MG3-6/3-8 mApoa1 BE F4 | mA*mG*mG*rArArCrGrGrCrUrGrGrGrCrCrCrArUrUrGrArCr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrUrCrCrArArUrArGrGrArGrCrG rGrGrCrGrGrUrArUrGrU*mU*mU*mU |
| 1436 | MG3-6/3-8 mApoa1 BE A5 | mC*mU*mG*rGrGrArUrArArCrCrUrGrGrArGrArArArGrArA rGrUrUrGrArGrArArUrCrGrArArArGrArUrUrCrUrUrArArUr ArArGrGrCrArUrCrCrUrUrCrCrGrArUrGrCrUrGrArCrUrUrCr UrCrArCrCrGrUrCrCrGrUrUrUrUrCrCrArArUrArGrGrArGrCr GrGrGrCrGrGrUrArUrGrU*mU*mU*mU |

TABLE 13A-continued

Guide sequences used in Example 40

| SEQ ID NO: | sgRNA name | Sequence |
|---|---|---|
| 1437 | MG3-6/3-8 mApoa1 BE E12 | mC*mC*mU*rGrGrUrGrUrGrGrUrArCrUrCrGrUrUrCrArArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1438 | MG3-6/3-8 mApoa1 BE A11 | mA*mG*mC*rArUrGrGrGrCrArUrCrArGrArCrUrArUrGrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1439 | MG3-6/3-8 mApoa1 BE B4 | mC*mU*mC*rCrUrGrGrArArArArCrUrGrGrGrArCrArCrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1440 | MG3-6/3-8 mApoa1 BE G4 | mG*mG*mA*rArCrGrGrCrUrGrGrGrCrCrCrArUrUrGrArCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1441 | MG3-6/3-8 mApoa1 BE B2 | mG*mC*mC*rArCrArGrGrGrGrArCrArGrUrCrUrCrCrCrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1442 | MG3-6/3-8 mApoa1 BE D7 | mC*mA*mG*rCrGrArArCrArGrArUrGrCrGrCrGrArGrArGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1443 | MG3-6/3-8 mApoa1 BE B5 | mA*mU*mU*rGrGrGrUrGrArGrArCrArGrGrArGrArUrGrArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1444 | MG3-6/3-8 mApoa1 BE G6 | mA*mG*mG*rGrArGrArCrUrGrUrCrCrCrCrUrGrUrGrGrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1445 | MG3-6/3-8 mApoa1 BE A8 | mC*mC*mU*rArCrCrUrUrGrArArCrGrArGrUrArCrCrArCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1446 | MG3-6/3-8 mApoa1 BE F2 | mG*mG*mC*rCrCrArArGrGrArGrGrArGrGrArUrUrCrArArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1447 | MG3-6/3-8 mApoa1 BE E1 | mA*mG*mC*rArArGrArUrGrArArCrCrCrCrArGrUrCrCrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1448 | MG3-6/3-8 mApoa1 BE B8 | mC*mU*mA*rCrCrUrUrGrArArCrGrArGrUrArCrCrArCrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

TABLE 13A-continued

Guide sequences used in Example 40

| SEQ ID NO: | sgRNA name | Sequence |
|---|---|---|
| 1449 | MG3-6/3-8 mApoa1 BE H8 | mC*mA*mU*rGrCrUrGrGrArGrArCrGrCrUrUrArArGrArCrCr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrCrCrArArUrArGrGrArGrCrG rGrGrCrGrGrUrArUrGrU*mU*mU*mU |
| 1450 | MG3-6/3-8 mApoa1 BE H6 | mU*mC*mG*rCrGrArCrCrGrCrArUrGrCrGrCrArCrArCrArCr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrCrCrArArUrArGrGrArGrCrG rGrGrCrGrGrUrArUrGrU*mU*mU*mU |
| 1451 | MG3-6/3-8 mApoa1 BE F5 | mA*mC*mG*rArArUrUrCrCrArGrArArGrArArArUrGrGrArA rGrUrUrGrArGrArArUrCrGrArArArGrArUrUrCrUrUrArArUr ArArGrGrCrArUrCrCrUrUrCrCrGrArUrGrCrUrGrArCrUrUrCr UrCrArCrCrGrUrCrCrGrUrUrUrCrCrArArUrArGrGrArGrCr GrGrGrCrGrGrUrArUrGrU*mU*mU*mU |
| 1452 | MG3-6/3-8 mApoa1 BE H3 | mC*mU*mA*rGrCrCrUrGrArArUrCrUrCrCrUrGrGrArArArAr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrCrCrArArUrArGrGrArGrCrG rGrGrCrGrGrUrArUrGrU*mU*mU*mU |
| 1453 | MG3-6/3-8 mApoa1 BE H4 | mU*mG*mG*rGrCrCrCrArUrUrGrArCrUrCrGrGrGrArCrUrUr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrCrCrArArUrArGrGrArGrCrG rGrGrCrGrGrUrArUrGrU*mU*mU*mU |
| 1454 | MG3-6/3-8 mApoa1 BE E8 | mC*mG*mA*rGrArArArGrCrCrArGrArCrCrUrGrCrGrCrUrGr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrCrCrArArUrArGrGrArGrCrG rGrGrCrGrGrUrArUrGrU*mU*mU*mU |
| 1455 | MG3-6/3-8 mApoa1 BE F12 | CTGGTGTGGTACTCGTTCAAGG |
| 1456 | MG3-6/3-8 mApoa1 BE D11 | ACTATGGCGCAGGTCCTCCAGC |
| 1457 | MG3-6/3-8 mApoa1 BE C5 | TTGGGTGAGACAGGAGATGAAC |
| 1458 | MG3-6/3-8 mApoa1 BE A4 | TCTCCTGGAAAACTGGGACACT |
| 1459 | MG3-6/3-8 mApoa1 BE F4 | AGGAACGGCTGGGCCCATTGAC |
| 1460 | MG3-6/3-8 mApoa1 BE A5 | CTGGGATAACCTGGAGAAAGAA |
| 1461 | MG3-6/3-8 mApoa1 BE E12 | CCTGGTGTGGTACTCGTTCAAG |
| 1462 | MG3-6/3-8 mApoa1 BE A11 | AGCATGGGCATCAGACTATGGC |
| 1463 | MG3-6/3-8 mApoa1 BE B4 | CTCCTGGAAAACTGGGACACTC |
| 1464 | MG3-6/3-8 mApoa1 BE G4 | GGAACGGCTGGGCCCATTGACT |
| 1465 | MG3-6/3-8 mApoa1 BE B2 | GCCACAGGGGACAGTCTCCCTT |
| 1466 | MG3-6/3-8 mApoa1 BE D7 | CAGCGAACAGATGCGCGAGAGC |
| 1467 | MG3-6/3-8 mApoa1 BE B5 | ATTGGGTGAGACAGGAGATGAA |

TABLE 13A-continued

Guide sequences used in Example 40

| SEQ ID NO: | sgRNA name | Sequence |
|---|---|---|
| 1468 | MG3-6/3-8 mApoa1 BE G6 | AGGGAGACTGTCCCCTGTGGCT |
| 1469 | MG3-6/3-8 mApoa1 BE A8 | CCTACCTTGAACGAGTACCACA |
| 1470 | MG3-6/3-8 mApoa1 BE F2 | GGCCCAAGGAGGAGGATTCAAA |
| 1471 | MG3-6/3-8 mApoa1 BE E1 | AGCAAGATGAACCCCAGTCCCA |
| 1472 | MG3-6/3-8 mApoa1 BE B8 | CTACCTTGAACGAGTACCACAC |
| 1473 | MG3-6/3-8 mApoa1 BE H8 | CATGCTGGAGACGCTTAAGACC |
| 1474 | MG3-6/3-8 mApoa1 BE H6 | TCGCGACCGCATGCGCACACAC |
| 1475 | MG3-6/3-8 mApoa1 BE F5 | ACGAATTCCAGAAGAAATGGAA |
| 1476 | MG3-6/3-8 mApoa1 BE H3 | CTAGCCTGAATCTCCTGGAAAA |
| 1477 | MG3-6/3-8 mApoa1 BE H4 | TGGGCCCATTGACTCGGGACTT |
| 1478 | MG3-6/3-8 mApoa1 BE E8 | CGAGAAAGCCAGACCTGCGCTG |
| 1479 | MG3-6/3-8 mAngptl3 BE C12 | mA*mC*mU*rArUrUrArArArCrCrArArGrArArArCrUrCrCrCr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrUrCrCrArArUrArGrGrArGrCrG rGrGrCrGrGrUrArUrGrU*mU*mU*mU |
| 1480 | MG3-6/3-8 mAngptl3 BE B2 | mC*mG*mA*rArArCrArUrGrGrGrArArArArCrUrArCrGrArA rGrUrUrGrArGrArArUrCrGrArArArGrArUrUrCrUrUrArArUr ArArGrGrCrArUrCrCrUrUrCrCrGrArUrGrCrUrGrArCrUrUrCr UrCrArCrCrGrUrCrCrGrUrUrUrUrCrCrArArUrArGrGrArGrCr GrGrGrCrGrGrUrArUrGrU*mU*mU*mU |
| 1481 | MG3-6/3-8 mAngptl3 BE C1 | mA*mG*mU*rArArUrUrGrCrArUrCrCrArGrArGrUrGrGrArU rGrUrUrGrArGrArArUrCrGrArArArGrArUrUrCrUrUrArArUr ArArGrGrCrArUrCrCrUrUrCrCrGrArUrGrCrUrGrArCrUrUrCr UrCrArCrCrGrUrCrCrGrUrUrUrUrCrCrArArUrArGrGrArGrCr GrGrGrCrGrGrUrArUrGrU*mU*mU*mU |
| 1482 | MG3-6/3-8 mAngptl3 BE F3 | mA*mA*mG*rArGrArArGrArCrArGrCrCrCrUrUrCrArArCrAr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrUrCrCrArArUrArGrGrArGrCrG rGrGrCrGrGrUrArUrGrU*mU*mU*mU |
| 1483 | MG3-6/3-8 mAngptl3 BE G1 | mU*mU*mU*rArGrCrGrArArUrGrGrCrCrUrCrCrUrGrCrArGr GrUrUrGrArGrArArUrCrGrArArArGrArUrUrCrUrUrArArUrA rArGrGrCrArUrCrCrUrUrCrCrGrArUrGrCrUrGrArCrUrUrCrU rCrArCrCrGrUrCrCrGrUrUrUrUrCrCrArArUrArGrGrArGrCrG rGrGrCrGrGrUrArUrGrU*mU*mU*mU |
| 1484 | MG3-6/3-8 mAngptl3 BE C12 | ACTATTAAACCAAGAAACTCCC |
| 1485 | MG3-6/3-8 mAngptl3 BE B2 | CGAAACATGGGAAAACTACGAA |
| 1486 | MG3-6/3-8 mAngptl3 BE C1 | AGTAATTGCATCCAGAGTGGAT |

TABLE 13A-continued

| SEQ ID NO: | sgRNA name | Sequence |
|---|---|---|
| Guide sequences used in Example 40 | | |
| 1487 | MG3-6/3-8 mAngpt13 BE F3 | AAGAGAAGACAGCCCTTCAACA |
| 1488 | MG3-6/3-8 mAngpt13 BE G1 | TTTAGCGAATGGCCTCCTGCAG |
| 1489 | MG3-6/3-8 mTrac BE E1 | mA*mC*mC*rArGrUrUrArArArArGrArUrCrCrUrCrGrGrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1490 | MG3-6/3-8 mTrac BE D10 | mU*mU*mC*rArCrArArUrCrCrCrArCrCrUrGrGrArUrCrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 1491 | MG3-6/3-8 mTrac BE E1 | ACCAGTTAAAAGATCCTCGGTC |
| 1492 | MG3-6/3-8 mTrac BE D10 | TTCACAATCCCACCTGGATCTC |

r = native ribose base, m = 2'-O methyl modified base, F = 2'-fluoro modified base, * = phosphorothioate bond While the pattern of base conversion varied across spacers, detectable conversion was observed across an editing of A4 to A15. To assess background at these genomic regions, NGS primer pairs used for the experimental samples were used in mock nucleofected samples and showed low to undetectable background conversion (0-0.12%) (FIG. 54). In summary, engineered dimeric 3-68 ABE exhibits high editing activity in mammalian cells at three independent loci and across a large panel of guides.

Example 41—mRNA Cytidine Base Editors

To test the activity of the engineered cytidine deaminases at scale, 527 chemically-synthesized guides suitable for use with MG3-6/3-8 to target four therapeutically relevant loci in the mouse genome were designed and purchased from IDT. These guides were co-transfected with in vitro synthesized mRNA in Hepa1-6 (a mouse immortalized mouse hepatocyte cell line) via nucleofection, and C to T conversion was assayed three days post-nucleofection. Prior to harvesting, individual wells were visually assessed for cell viability based on cell growth and presence of floating cells in media. The 3-68 152-6 CBE did not show appreciable cytotoxicity compared to mock samples.

Cell Culture, Transfections, Next Generation Sequencing, and Base Edit Analysis for Screens (Prophetic)

Hepa1-6 cells are grown and passaged in Dulbecco's Modified Eagle's Medium plus 1× NEAA (gibco) supplemented with 10% (v/v) fetal bovine serum (gibco) and 1% pen-strep at 37° C. with 5% $CO_2$. $1\times10^5$ cells are nucleofected with 500 ng IVT mRNA and 150 pmol chemically synthesized sgRNA (IDT) using a Lonza-4D Nucleofector® (program EH-100). Cells are grown for 3 days, visually assessed for viability, harvested, and gDNA is extracted with QuickExtract (Lucigen) according to the manufacturer's instructions. Targeted regions for base edits are amplified using Q5® High-Fidelity DNA polymerase (New England Biolabs) with primers appropriate for use with NGS-based DNA sequencing and extracted DNA as the templates. PCR products are purified by HighPrep PCR Clean-up System (MAGBIO) according to the manufacturer's instructions. Amplicons are sequenced on an Illumina MiSeq machine and analyzed with a proprietary Python script to measure gene editing.

Example 42—Base Editing Preferences for nMG35-1 ABE

As described in Example 39, *E. coli* was transformed with a plasmid containing the nMG35-1-ABE, a non-functional chloramphenicol acetyltransferase (CAT Y193) gene, and an sgRNA that either targets the CAT gene (targeting spacer) or not (scrambled spacer). Cell growth is dependent on the ABE base editing the non-functional CAT gene (A at position 17 from the TAM) (FIG. 55A) to its wild-type variant (H193) and restoring activity. Multiple linkers were evaluated for nMG35-1 fusions to the TadA deaminase monomer (Table 14).

TABLE 14

Linkers evaluated for nMG35-1 fusions with a TadA deaminase.

| Length | Sequence | SEQ ID NO |
|---|---|---|
| 7 AAs | PAPAPAP | 1654 |
| 14 AAs | KLGGGAPAVGGGPK | 1655 |

TABLE 14-continued

| Linkers evaluated for nMG35-1 fusions with a TadA deaminase. | | |
|---|---|---|
| Length | Sequence | SEQ ID NO |
| 15 AAs | GGGGSGGGGSGGGGS | 1649 |
| XTEN (17 aa) | SGSETPGTSEASTPESA | 1650 |
| 26 AAs | GGGGSGGGGSEAAAAKGGGGSGGGGS | 1651 |
| 32 AAs | GGGGSGGGGSEAAAAKEAAAAKGGGGSGGGGS | 1652 |
| 44 AAs | KGKGKGMGAGTLSTDKGESLGIKYEEGQSHRPTNPNASR MAQKV | 1653 |

Results

Base editing was tested in an *E. coli* positive selection assay targeting the chloramphenicol acetyltransferase (CAT) gene that was expressed from the same plasmid co-expressing the MG35-1 ABE containing various linkers. The nMG35-1 ABE construct with the 17 amino acid linker (XTEN) outperformed other linkers in base editing experiments (FIG. 55B-55E). In addition, when analyzing the adenine positions across the targeting spacer that were edited by the nMG35-1 ABE, the A at the 9th position (in the middle of the spacer region) showed the highest editing levels in *E. coli* (FIG. 55D).

Example 43—the nMG35-1 ABE Edits Additional Target Sites in *E. Coli*

*E. Coli* Positive Selection

As described in Example 39, a single plasmid construct encompassing a nickase MG35-1 (D59A mutation), a C-terminally fused TadA*-(7.10) monomer, and a C-terminus SV40 NLS (SEQ ID NO: 369) was tested as a base editor with its compatible sgRNA containing a 20 bp spacer sequence targeting the chloramphenicol acetyltransferase (CAT) gene. A non-targeting sgRNA lacking a spacer sequence was used as negative control. The CAT gene contained either an engineered stop codon (at amino acid positions 98 or 122) or a H193Y mutation that renders the CAT gene nonfunctional (FIGS. 56A and 56B). The ABE construct, sgRNA, and non-functional CAT gene were cloned into a pET-21 backbone containing Ampicillin resistance. Ten ng of the plasmid was transformed into 25 μL of BL21(DE3) (Lucigen) *E. coli* cells and incubated at 37° C. in 450 μL of recovery media for 90 minutes. Next, 70 μL of recovery media containing transformed cells was plated onto plates containing chloramphenicol concentrations of 0, 2, 3, 4, and 8 μg/mL. The 0 μg/mL plate was used as a transformation control. Plates also contained 100 μg/mL Carbecillin and 0.1 mM IPTG. Plates were left at 37° C. for 40 hours. CAT mutations were verified in the resulting colonies by Sanger sequencing (Elim Biopharmaceuticals, Inc).

Results

The A to G editing of the nMG35-1 ABE was tested in a positive selection single-plasmid *E. coli* system in which the ABE is required to revert a chloramphenicol acetyltransferase (CAT) gene stop codon mutation back to glutamine or a tyrosine mutation back to histidine (FIGS. 56A and 56B) in order for *E. coli* to survive growth under chloramphenicol selection. Four distinct non-functional CAT genes were tested for reversion by the nMG35-1 ABE: three single mutations (a stop codon at residue 98 reversion to Q; a stop codon at residue 122 reversion to Q; and Y at residue 193 reversion to H) and a double mutation in which a CAT gene contains two stop codons at both residues 98 and 122 (both need to be reverted to Q simultaneously to restore CAT gene functionality). These four conditions were tested alongside paired negative controls in which the non-functional CAT genes were co-expressed with sgRNAs missing a spacer sequence. The nMG35-1 ABE successfully edited the four conditions, including the double mutant reversion, as shown by an enrichment of *E. coli* colonies when grown on plates containing 2 and 4 μg/mL of chloramphenicol (FIG. 56C, "targeting" row). Few colonies also grew on the plate containing 8 μg/mL of chloramphenicol for reversion of the individual stop codon mutations at residues 98 and 122 (FIG. 56C, "targeting" row). Sanger sequencing of the colonies growing on the 2 μg/mL plate from the CAT double mutant reversion determined that 17 of 18 colonies showed the expected A to G edit at both target sites (FIG. 56D). No colonies were seen on the 2, 4, and 8 μg/mL plates plated with *E. coli* transformed with the non-targeting guide (FIG. 56C, "no spacer" row), confirming that the nMG35-1-ABE is a successful base editor in *E. coli.*

When the predicted 3D structure of MG35-1 is aligned to the cryoEM structure of an IscB nuclease (PDB: 7UTN), the PLMP domain of IscB aligns with amino acid (AAs) positions 1-53 of MG35-1. A nickase nMG35-1 ABE with a deletion of AAs 1-53 was tested in the bacterial positive selection assay in which the ABE needs to revert a Y193 mutation to H within the CAT gene to restore CAT functionality (FIG. 57). When these AAs were truncated from the nMG35-1 ABE, *E. coli* was unable to survive chloramphenicol selection at the minimum inhibitory chloramphenicol concentration of 2 μg/mL. These results suggest that AAs 1-53 of MG35-1 drive efficient base editing of the MG35-1 ABE in *E. coli* cells.

Example 44—Base Editing in Human Cells with nMG35-1-ABE (Prophetic)

In order to demonstrate that an nMG35-1-ABE system is capable of base editing in human cells, a nickase MG35-1 (D59A mutation), a C-terminally fused TadA(8.8m) deaminase monomer, and a C-terminus SV40 NLS fusion system is constructed. HEK293T cells are grown and passaged in Dulbecco's Modified Eagle's Medium plus GlutaMAX™ (gibco) supplemented with 10% (v/v) fetal bovine serum (gibco) at 37° C. with 5% $CO_2$. About $2.5\times10^4$ cells are seeded on 96-well cell culture plates treated for cell attachment (Costar), and grown for 20 to 24 h (spent media are refreshed with new media before transfection). Each plate well receives 300 ng expression plasmid and 1 μL Lipofectamine™ 2000 (ThermoFisher Scientific) for transfection according to the manufacturer's instructions. Transfected cells are grown for three days, harvested, and genomic DNA is extracted with QuickExtract (Lucigen) according to the manufacturer's instructions. Targeted regions for base edits are amplified using Q5® High-Fidelity DNA polymerase (New England Biolabs) with target-specific primers and PCR products purified with the HighPrep PCR Clean-up System (MAGBIO) according to the manufacturer's instructions. To analyze nMG35-1-ABE base editing in human cells, adapters used for next generation sequencing (NGS) are appended to PCR products by subsequent PCR reactions using the KAPA HiFi HotStart ReadyMix PCR Kit (Roche) and primers compatible with TruSeq™ DNA Library Prep Kits (Illumina). DNA concentrations of the resulting products are quantified by TapeStation (Agilent), and samples are pooled to prepare the library for NGS analysis. The resulting library is quantified by qPCR with the Aria Real-time PCR System (Agilent), and high throughput sequencing is performed with an Illumina Miseq instrument per manufacturer's instructions.

While preferred embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents. It is intended that the following claims define the scope of the invention and that methods and structures within the scope of these claims and their equivalents be covered thereby.

TABLE 15

Listing of PAM sequences referred to herein

| Sequence Number | Sequence |
|---|---|
| A360 | nRRR |
| A361 | nnRRAY |
| A362 | nnRGGnT |
| A363 | nnRnYAY |
| A364 | — |
| A365 | nRCCV |
| A366 | nRnnGRKA |
| A367 | nnnnC |
| A368 | nRWART |
| A598 | NGG |
| A1106 | AnGg |
| A1107 | nARAA |
| A1108 | ATGaaa |
| A1109 | ATGA |
| A1110 | WTGG |
| A1111 | RTGA |

EMBODIMENTS

The following embodiments are not intended to be limiting in any way.

Embodiment 1. An engineered nucleic acid editing system, comprising:

(a) an endonuclease comprising a RuvC domain and an HNH domain, wherein said endonuclease is derived from an uncultivated microorganism, wherein said endonuclease is a class 2, type II endonuclease, wherein said endonuclease is configured to be deficient in nuclease activity;

(b) a base editor coupled to said endonuclease; and (c) an engineered guide ribonucleic acid structure configured to form a complex with said endonuclease comprising:

i. a guide ribonucleic acid sequence configured to hybridize to a target deoxyribonucleic acid sequence; and ii. a ribonucleic acid sequence configured to bind to said endonuclease.

Embodiment 2. The engineered nucleic acid editing system of Embodiment 1, wherein said RuvC domain lacks nuclease activity.

Embodiment 3. The engineered nucleic acid editing system of Embodiment 1, wherein said endonuclease is configured to cleave one strand of a double-stranded target deoxyribonucleic acid.

Embodiment 4. The engineered nucleic acid editing system of Embodiment 1 or Embodiment 2, wherein said class 2, type II endonuclease comprises a nickase mutation.

Embodiment 5. The engineered nucleic acid editing system of any one of Embodiment 1-Embodiment 4, wherein said endonuclease comprises a sequence with at least 95% sequence identity to any one of SEQ ID NOs:70-78 or 597, or a variant thereof.

Embodiment 6. The engineered nucleic acid editing system of any one of Embodiment 1-Embodiment 5, wherein said class 2, type II endonuclease comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597 when optimally aligned.

Embodiment 7. The engineered nuclease system of any one of Embodiment 1-Embodiment 5, wherein said endonuclease comprises an aspartate to alanine mutation at residue 9 relative to SEQ ID NO: 70, residue 13 relative to SEQ ID NO: 72, or residue 17 relative to SEQ ID NO: 75 when optimally aligned.

Embodiment 8. An engineered nucleic acid editing system comprising:

(a) an endonuclease having at least 95% sequence identity to any one of SEQ ID NOs: 70-78, 596, or 597, Sequence Number: A598, or a variant thereof;

(b) a base editor coupled to said endonuclease; and (c) an engineered guide ribonucleic acid structure configured to form a complex with said endonuclease comprising:

i. a guide ribonucleic acid sequence configured to hybridize to a target deoxyribonucleic acid sequence; and ii. a ribonucleic acid sequence configured to bind to said endonuclease.

Embodiment 9. An engineered nucleic acid editing system comprising:

(a) an endonuclease configured to bind to a protospacer adjacent motif (PAM) sequence comprising any one of Sequence Numbers: A360-A368 or A598, or a variant thereof, wherein said endonuclease is a class 2, type II endonuclease, and wherein said endonuclease is configured to be deficient in nuclease activity;

(b) a base editor coupled to said endonuclease; and (c) an engineered guide ribonucleic acid structure configured to form a complex with said endonuclease comprising:

i. a guide ribonucleic acid sequence configured to hybridize to a target deoxyribonucleic acid sequence; and ii. a ribonucleic acid sequence configured to bind to said endonuclease.

Embodiment 10. The engineered nucleic acid editing system of Embodiment 9, wherein said endonuclease comprises a nickase mutation.

Embodiment 11. The engineered nucleic acid editing system of Embodiment 9, wherein said endonuclease is configured to cleave one strand of a double-stranded target deoxyribonucleic acid.

Embodiment 12. The engineered nucleic acid editing system of Embodiment 9, wherein said class 2, type II endonuclease comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597 when optimally aligned.

Embodiment 13. The engineered nucleic acid editing system of Embodiment 9, wherein said base editor comprises a sequence having at least 70%, 80%, 90% or 95% identity to any one of SEQ ID NOs: 1-51, 57-66, 385-443, 444-475, 594-595, or 599-675, or a variant thereof.

Embodiment 14. The engineered nucleic acid editing system of Embodiment 9, wherein said base editor comprises a sequence having at least 70%, 80%, 90% or 95% identity to any one of SEQ ID NOs: 50-51 or 385-390.

Embodiment 15. The engineered nucleic acid editing system of any one of Embodiment 8-Embodiment 14, wherein said endonuclease comprises a RuvC domain lacking nuclease activity.

Embodiment 16. The engineered nucleic acid editing system of any one of Embodiment 8-Embodiment 15, wherein said endonuclease is derived from an uncultivated microorganism.

Embodiment 17. The engineered nucleic acid editing system of any one of Embodiment 8-Embodiment 16, wherein said endonuclease has less than 80% identity to a Cas9 endonuclease.

Embodiment 18. The engineered nucleic acid editing system of any one of Embodiment 8-Embodiment 17, wherein said endonuclease further comprises an HNH domain.

Embodiment 19. The engineered nucleic acid editing system of any one of Embodiment 1-Embodiment 18, wherein said engineered guide ribonucleic acid sequence comprises a sequence with at least 80% sequence identity to non-degenerate nucleotides of any one of SEQ ID NOs: 88-96, 488-489, or 679-680, or a variant thereof.

Embodiment 20. An engineered nucleic acid editing system comprising, (a) an engineered guide ribonucleic acid structure comprising:

(i) a guide ribonucleic acid sequence configured to hybridize to a target deoxyribonucleic acid sequence; and (ii) a ribonucleic acid sequence configured to bind to an endonuclease, wherein said engineered ribonucleic acid sequence comprises a sequence with at least 80% sequence identity to non-degenerate nucleotides of any one of SEQ ID NOs: 88-96, 488-489, or 679-680, or a variant thereof; and (b) a class 2, type II endonuclease configured to bind to said engineered guide ribonucleic acid; and (c) a base editor coupled to said endonuclease.

Embodiment 21. The engineered nucleic acid editing system of Embodiment 20, wherein said endonuclease is configured to bind to a protospacer adjacent motif (PAM) sequence selected from the group consisting of Sequence Numbers: A360-A368 or A598.

Embodiment 22. The engineered nucleic acid editing system of any one of Embodiment 1-Embodiment 21, wherein said base editor comprises a sequence with at least 70%, 80%, 90% or 95% identity to any one of SEQ ID NOs: 1-51, 57-66, 385-443, 444-475, 594-595, or 599-675, or a variant thereof.

Embodiment 23. The engineered nucleic acid editing system of any one of Embodiment 1-Embodiment 22, wherein said base editor comprises a sequence having at least 70%, 80%, 90% or 95% identity to any one of SEQ ID NOs: 50-51 or 385-390.

Embodiment 24. The engineered nucleic acid editing system of any of embodiments Embodiment 1-Embodiment 22, wherein said base editor is an adenine deaminase.

Embodiment 25. The engineered nucleic acid editing system of Embodiment 23, wherein said adenosine deaminase comprises a sequence with at least 70%, 80%, 90% or 95% identity to any one of SEQ ID NOs: 50-51, 57, 385-443, 448-475, or 595, or a variant thereof.

Embodiment 26. The engineered nucleic acid editing system of any of Embodiment 1-Embodiment 22, wherein said base editor is a cytidine deaminase.

Embodiment 27. The engineered nucleic acid editing system of Embodiment 26, wherein said cytidine deaminase comprises a sequence with at least 70%, 80%, 90% or 95% identity to any one of SEQ ID NOs: 1-49, 444-447, 594, 58-66, or 599-675, or a variant thereof.

Embodiment 28. The engineered nucleic acid editing system of any one of Embodiment 1-Embodiment 27, comprising a uracil DNA glycosylase inhibitor (UGI) coupled to said endonuclease or said base editor.

Embodiment 29. The engineered nucleic acid editing system of Embodiment 28, wherein said uracil DNA glycosylase inhibitor (UGI) comprises a sequence with at least 70%, 80%, 90% or 95% identity to any one of SEQ ID NOs: 52-56 or SEQ ID NO: 67.

Embodiment 30. The engineered nucleic acid editing system of any one of embodiments 1-Embodiment 29, wherein said engineered guide ribonucleic acid structure comprises at least two ribonucleic acid polynucleotides.

Embodiment 31. The engineered nucleic acid editing system of any one of embodiments 1-Embodiment 29, wherein said engineered guide ribonucleic acid structure comprises one ribonucleic acid polynucleotide comprising said guide ribonucleic acid sequence and said ribonucleic acid sequence configured to bind to an endonuclease.

Embodiment 32. The engineered nucleic acid editing system of any one of Embodiment 1-Embodiment 31, wherein said guide ribonucleic acid sequence is complementary to a prokaryotic, bacterial, archaeal, eukaryotic, fungal, plant, mammalian, or human genomic sequence.

Embodiment 33. The engineered nucleic acid editing system of any one of Embodiment 1-Embodiment 32, wherein said guide ribonucleic acid sequence is 15-24 nucleotides in length.

Embodiment 34. The engineered nucleic acid editing system of any one of embodiments 1-Embodiment 33, further comprising one or more nuclear localization sequences (NLSs) proximal to an N- or C-terminus of said endonuclease.

Embodiment 35. The engineered nucleic acid editing system of Embodiment 34, wherein said NLS comprises a sequence with at least 90% identity to a selected from SEQ ID NOs: 369-384, or a variant thereof.

Embodiment 36. The engineered nucleic acid editing system of any one of Embodiment 1-Embodiment 35, wherein said endonuclease is covalently coupled directly to said base editor or covalently coupled to said base editor through a linker.

Embodiment 37. The engineered nucleic acid editing system of Embodiment 36, wherein a polypeptide comprises said endonuclease and said base editor.

Embodiment 38. The engineered nucleic acid editing system of any one of Embodiment 1-Embodiment 37, wherein said endonuclease is configured to cleave one strand of a double-stranded target deoxyribonucleic acid.

Embodiment 39. The engineered nucleic acid editing system of any one of Embodiment 1-Embodiment 38, wherein said system further comprises a source of $Mg^{2+}$.

Embodiment 40. The engineered nucleic acid editing system of any one of embodiments 1-Embodiment 39, wherein:

a) said endonuclease comprises a sequence at least 70%, at least 80%, or at least 90% identical to any one of SEQ ID NOs: 70, 71, 73, 74, 76, 78, 77, or 78, or a variant thereof;
b) said guide RNA structure comprises a sequence at least 70%, at least 80%, or at least 90% identical to non-degenerate nucleotides of any one of SEQ ID NOs: 88, 89, 91, 92, 94, 96, 95, or 488;
c) said endonuclease is configured to bind to a PAM comprising any one of Sequence Numbers: A360, A361, A363, A365, A367, or A368; or
d) said base editor comprises a sequence at least 70%, at least 80%, or at least 90% identical to SEQ ID NOs: 58 or 595, or a variant thereof.

Embodiment 41. The engineered nucleic acid editing system of any one of embodiments 1-Embodiment 39, wherein:

a) said endonuclease comprises a sequence at least 70%, at least 80%, or at least 90% identical to any one of SEQ ID NOs: 70, 71, or 78, or a variant thereof;
b) said guide RNA structure comprises a sequence at least 70%, at least 80%, or at least 90% identical to non-degenerate nucleotides of at least one of SEQ ID NOs: 88, 89, or 96;
c) said endonuclease is configured to bind to a PAM comprising any one of Sequence Numbers: A360, A362, or A368; or
d) said base editor comprises a sequence at least 70%, at least 80%, or at least 90% identical to SEQ ID NO: 594, or a variant thereof.

Embodiment 42. The engineered nucleic acid editing system of any one of embodiments 1-Embodiment 41, wherein said sequence identity is determined by a BLASTP, CLUSTALW, MUSCLE, MAFFT, or Smith-Waterman homology search algorithm.

Embodiment 43. The engineered nucleic acid editing system of Embodiment 42, wherein said sequence identity is determined by said BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment.

Embodiment 44. The engineered nucleic acid editing system of any one of Embodiment 1-Embodiment 43, wherein said endonuclease is configured to be catalytically dead.

Embodiment 45. A nucleic acid comprising an engineered nucleic acid sequence optimized for expression in an organism, wherein said nucleic acid encodes a class 2, type II endonuclease coupled to a base editor, and wherein said endonuclease is derived from an uncultivated microorganism.

Embodiment 46. A nucleic acid comprising an engineered nucleic acid sequence optimized for expression in an organism, wherein said nucleic acid encodes an endonuclease having at least 70% sequence identity to any one of SEQ ID NOs: 70-78 coupled to a base editor.

Embodiment 47. The nucleic acid of any one of Embodiment 44-Embodiment 46, wherein said endonuclease comprises a sequence encoding one or more nuclear localization sequences (NLSs) proximal to an N- or C-terminus of said endonuclease.

Embodiment 48. The nucleic acid of Embodiment 47, wherein said NLS comprises a sequence with at least 90% identity to a selected from SEQ ID NOs: 369-384, or a variant thereof.

Embodiment 49. The nucleic acid of any one of Embodiment 44-Embodiment 48, wherein said organism is prokaryotic, bacterial, eukaryotic, fungal, plant, mammalian, rodent, or human.

Embodiment 50. A vector comprising a nucleic acid sequence encoding a class 2, type II endonuclease coupled to a base editor, wherein said endonuclease is derived from an uncultivated microorganism.

Embodiment 51. A vector comprising the nucleic acid of any of embodiments Embodiment 44-Embodiment 49.

Embodiment 52. The vector of any of Embodiment 50-Embodiment 51, further comprising a nucleic acid encoding an engineered guide ribonucleic acid structure configured to form a complex with said endonuclease comprising:

a) a guide ribonucleic acid sequence configured to hybridize to a target deoxyribonucleic acid sequence; and
b) a ribonucleic acid sequence configured to binding to said endonuclease.

Embodiment 53. The vector of any of Embodiment 50-Embodiment 52, wherein the vector is a plasmid, a minicircle, a CELiD, an adeno-associated virus (AAV) derived virion, or a lentivirus.

Embodiment 54. A cell comprising the vector of any of Embodiment 50-Embodiment 53.

Embodiment 55. A method of manufacturing an endonuclease, comprising cultivating said cell of Embodiment 54.

Embodiment 56. A method for modifying a double-stranded deoxyribonucleic acid polynucleotide comprising contacting said double-stranded deoxyribonucleic acid polynucleotide with a complex comprising:

a) an endonuclease comprising a RuvC domain and an HNH domain, wherein said endonuclease is derived from an uncultivated microorganism, wherein said endonuclease is a class 2, type II endonuclease, and wherein said RuvC domain lacks nuclease activity;

b) a base editor coupled to said endonuclease; and c) an engineered guide ribonucleic acid structure configured to bind to said endonuclease and said double-stranded deoxyribonucleic acid polynucleotide; wherein said double-stranded deoxyribonucleic acid polynucleotide comprises a protospacer adjacent motif (PAM).

Embodiment 57. The method of Embodiment 56, wherein said endonuclease comprising a RuvC domain and an HNH domain is covalently coupled directly to said base editor or covalently coupled to said base editor through a linker.

Embodiment 58. The method of Embodiment 56 or Embodiment 57, wherein said endonuclease comprising a RuvC domain and an HNH domain comprises a sequence with at least 95% sequence identity to any one of SEQ ID NOs:70-78 or 597, or a variant thereof.

Embodiment 59. The method of any one of Embodiment 56-Embodiment 57, wherein said endonuclease comprises an aspartate to alanine mutation at residue 9 relative to SEQ ID NO: 70, residue 13 relative to SEQ ID NOs: 71, 72, or 74, residue 12 relative to SEQ ID NO: 73 or 78, residue 17 relative to SEQ ID NO: 75, residue 23 relative to SEQ ID NO: 76, residue 8 relative to SEQ ID NO: 77, or residue 10 relative to SEQ ID NO: 597 when optimally aligned.

Embodiment 60. The method of any one of Embodiment 56-Embodiment 57, wherein said endonuclease comprises an aspartate to alanine mutation at residue 9 relative to SEQ ID NO: 70, residue 13 relative to SEQ ID NO: 72, or residue 17 relative to SEQ ID NO: 75 when optimally aligned.

Embodiment 61. A method for modifying a double-stranded deoxyribonucleic acid polynucleotide, comprising contacting said double-stranded deoxyribonucleic acid polynucleotide with a complex comprising:

a class 2, type II endonuclease, a base editor coupled to said endonuclease, and an engineered guide ribonucleic acid structure configured to bind to said endonuclease and said double-stranded deoxyribonucleic acid polynucleotide;

wherein said double-stranded deoxyribonucleic acid polynucleotide comprises a protospacer adjacent motif (PAM); and wherein said PAM comprises a sequence selected from the group consisting of SEQ ID NOs:70-78 or 597.

Embodiment 62. The method of Embodiment 61, wherein said class 2, type II endonuclease is covalently coupled to said base editor or coupled to said base editor through a linker.

Embodiment 63. The method of Embodiment 61 or Embodiment 62, wherein said base editor comprises a sequence with at least 70%, at least 80%, at least 90% or at least 95% identity to a sequence selected from SEQ ID NOs: 1-51, 57-66, 385-443, 444-475, 594-595, or 599-675, or a variant thereof.

Embodiment 64. The method of any one of Embodiment 61-Embodiment 63, wherein said base editor comprises an adenine deaminase;

said double-stranded deoxyribonucleic acid polynucleotide comprises an adenine; and modifying said double-stranded deoxyribonucleic acid polypeptide comprises converting said adenine to guanine.

Embodiment 65. The method of Embodiment 64, wherein said adenine deaminase comprises a sequence with at least 70%, 80%, 90% or 95% sequence identity to any one of SEQ ID NOs: 50-51, 57, 385-443, 448-475, or 595, or a variant thereof.

Embodiment 66. The method of any one of Embodiment 61-Embodiment 63, wherein said base editor comprises a cytidine deaminase;

said double-stranded deoxyribonucleic acid polynucleotide comprises a cytosine; and modifying said double-stranded deoxyribonucleic acid polypeptide comprises converting said cytosine to uracil.

Embodiment 67. The method of Embodiment 66, wherein said cytidine deaminase comprises a sequence with at least 70%, 80%, 90% or 95% sequence identity to any one of SEQ ID NOs: 1-49, 444-447, 594, 58-66, or 599-675, or a variant thereof.

Embodiment 68. The method of any one of Embodiment 61-Embodiment 67, wherein said complex further comprises a uracil DNA glycosylase inhibitor coupled to said endonuclease or said base editor.

Embodiment 69. The method of Embodiment 68, wherein said uracil DNA glycosylase inhibitor comprises a sequence with at least 70%, 80%, 90% or 95% identity to any one of SEQ ID NOs: 52-56 or SEQ ID NO: 67, or a variant thereof.

Embodiment 70. The method of any one of Embodiment 61-Embodiment 69, wherein said double-stranded deoxyribonucleic acid polynucleotide comprises a first strand comprising a sequence complementary to a sequence of said engineered guide ribonucleic acid structure and a second strand comprising said PAM.

Embodiment 71. The method of Embodiment 70, wherein said PAM is directly adjacent to the 3' end of said sequence complementary to said sequence of said engineered guide ribonucleic acid structure.

Embodiment 72. The method of any one of Embodiment 61-Embodiment 71, wherein said class 2, type II endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease.

Embodiment 73. The method of any one of Embodiment 61-Embodiment 72, wherein said class 2, type II endonuclease is derived from an uncultivated microorganism.

Embodiment 74. The method of any one of Embodiment 61-Embodiment 73, wherein said double-stranded deoxyribonucleic acid polynucleotide is a eukaryotic, plant, fungal, mammalian, rodent, or human double-stranded deoxyribonucleic acid polynucleotide.

Embodiment 75. A method of modifying a target nucleic acid locus, said method comprising delivering to said target nucleic acid locus said engineered nucleic acid editing system of any one of embodiments 1-Embodiment 44, wherein said endonuclease is configured to form a complex with said engineered guide ribonucleic acid structure, and wherein said complex is configured such that upon binding of said complex to said target nucleic acid locus, said complex modifies a nucleotide of said target nucleic locus.

Embodiment 76. The method of Embodiment 75, wherein said engineered nucleic acid editing system comprises an adenine deaminase, said nucleotide is an adenine, and modifying said target nucleic acid locus comprises converting said adenine to a guanine.

Embodiment 77. The method of Embodiment 75, wherein said engineered nucleic acid editing system comprises a cytidine deaminase and a uracil DNA glycosylase inhibitor, said nucleotide is a cytosine and modifying said target nucleic acid locus comprises converting said adenine to a uracil.

Embodiment 78. The method of any one of Embodiment 75-Embodiment 77, wherein said target nucleic acid locus comprises genomic DNA, viral DNA, or bacterial DNA.

Embodiment 79. The method of any one of Embodiment 75-Embodiment 78, wherein said target nucleic acid locus is in vitro.

Embodiment 80. The method of any one of Embodiment 75-Embodiment 78, wherein said target nucleic acid locus is within a cell.

Embodiment 81. The method of Embodiment 80, wherein said cell is a prokaryotic cell, a bacterial cell, a eukaryotic cell, a fungal cell, a plant cell, an animal cell, a mammalian cell, a rodent cell, a primate cell, or a human cell.

Embodiment 82. The method of any one of Embodiment 80-Embodiment 81, wherein said cell is within an animal.

Embodiment 83. The method of Embodiment 82, wherein said cell is within a cochlea.

Embodiment 84. The method of any one of Embodiment 80-Embodiment 81, wherein said cell is within an embryo.

Embodiment 85. The method of Embodiment 84, wherein said embryo is a two-cell embryo.

Embodiment 86. The method of Embodiment 84, wherein said embryo is a mouse embryo.

Embodiment 87. The method of any one of Embodiment 75-Embodiment 86, wherein delivering said engineered nucleic acid editing system to said target nucleic acid locus comprises delivering the nucleic acid of any of embodiments Embodiment 46-Embodiment 49 or the vector of any of embodiments Embodiment 50-Embodiment 53.

Embodiment 88. The method of any one of Embodiment 75-Embodiment 87, wherein delivering said engineered nucleic acid editing system to said target nucleic acid locus comprises delivering a nucleic acid comprising an open reading frame encoding said endonuclease.

Embodiment 89. The method of Embodiment 88, wherein said nucleic acid comprises a promoter to which said open reading frame encoding said endonuclease is operably linked.

Embodiment 90. The method of any one of Embodiment 75-Embodiment 89, wherein delivering said engineered nucleic acid editing system to said target nucleic acid locus comprises delivering a capped mRNA comprising said open reading frame encoding said endonuclease.

Embodiment 91. The method of any one of Embodiment 75-Embodiment 86, wherein delivering said engineered nucleic acid editing system to said target nucleic acid locus comprises delivering a polypeptide.

Embodiment 92. The method of any one of Embodiment 75-Embodiment 86, wherein delivering said engineered nucleic acid editing system to said target nucleic acid locus comprises delivering a deoxyribonucleic acid (DNA) encoding said engineered guide ribonucleic acid structure operably linked to a ribonucleic acid (RNA) pol III promoter.

Embodiment 93. An engineered nucleic acid editing polypeptide, comprising:

an endonuclease comprising a RuvC domain and an HNH domain, wherein said endonuclease is derived from an uncultivated microorganism, wherein said endonuclease is a class 2, type II endonuclease, and wherein said RuvC domain lacks nuclease activity; and a base editor coupled to said endonuclease.

Embodiment 94. The engineered nucleic acid editing polypeptide of Embodiment 93, wherein said endonuclease comprises a sequence with at least 95% sequence identity to any one of SEQ ID NOs:70-78 or 597, or a variant thereof.

Embodiment 95. An engineered nucleic acid editing polypeptide, comprising: an endonuclease having at least 95% sequence identity to any one of SEQ ID NOs:70-78 or 597, or a variant thereof, wherein said endonuclease comprises a RuvC domain lacking nuclease activity; and a base editor coupled to said endonuclease.

Embodiment 96. An engineered nucleic acid editing polypeptide, comprising:

an endonuclease configured to bind to a protospacer adjacent motif (PAM) sequence comprising any one of Sequence Numbers: A360-A368 or A598, wherein said endonuclease is a class 2, type II endonuclease, and wherein said endonuclease comprises a RuvC domain lacks nuclease activity; and a base editor coupled to said endonuclease.

Embodiment 97. The engineered nucleic acid editing polypeptide of Embodiment 95 or Embodiment 96, wherein said endonuclease is derived from an uncultivated microorganism.

Embodiment 98. The engineered nucleic acid editing polypeptide of any one of Embodiment 93-Embodiment 97, wherein said endonuclease has less than 80% identity to a Cas9 endonuclease.

Embodiment 99. The engineered nucleic acid editing polypeptide of any one of Embodiment 95-Embodiment 98, wherein said endonuclease further comprises an HNH domain.

Embodiment 100. The engineered nucleic acid editing polypeptide of any one of Embodiment 95-Embodiment 99, wherein said tracr ribonucleic acid sequence comprises a sequence with at least 80% sequence identity to about 60 to 90 consecutive nucleotides selected from any one of SEQ ID NOs: 88-96, 488, 489, and 679-680.

Embodiment 101. The engineered nucleic acid editing polypeptide of any one of Embodiment 93-Embodiment 100, wherein said base editor comprises a sequence with at least 70%, 80%, 90% or 95% identity to any one of SEQ ID NOs: 1-51, 57-66, 385-443, 444-475, 594-595, or 599-675, or a variant thereof.

Embodiment 102. The engineered nucleic acid editing polypeptide of any one of Embodiment 93-Embodiment 101, wherein said base editor is an adenine deaminase.

Embodiment 103. The engineered nucleic acid editing polypeptide of Embodiment 102, wherein said adenosine deaminase comprises a sequence with at least 70%, 80%, 90% or 95% sequence identity to any one of SEQ ID NOs: 50-51, 57, 385-443, 448-475, or 595, or a variant thereof.

Embodiment 104. The engineered nucleic acid editing polypeptide of any one of Embodiment 93-Embodiment 101, wherein said base editor is a cytidine deaminase.

Embodiment 105. The engineered nucleic acid editing polypeptide of Embodiment 104, wherein said cytidine deaminase comprises a sequence with at least 70%, 80%, 90% or 95% sequence identity to any one of SEQ ID NOs: 1-49, 444-447, 594, or 58-66, or a variant thereof.

Embodiment 106. An engineered nucleic acid editing polypeptide, comprising:

an endonuclease, wherein said endonuclease is configured to be deficient in endonuclease activity; and a base editor coupled to said endonuclease, wherein said base editor comprises a sequence with at least 70%, 80%, 90% or 95% sequence identity to any one of SEQ ID NOs: 1-51, 385-386, 387-443, 444-447, 488-475, 595, or 599-675, or a variant thereof.

Embodiment 107. The engineered nucleic acid editing polypeptide of Embodiment 106, wherein said endonuclease is configured to cleave one strand of a double-stranded target deoxyribonucleic acid.

Embodiment 108. The engineered nucleic acid editing polypeptide of Embodiment 106, wherein said endonuclease is configured to be catalytically dead.

Embodiment 109. The engineered nucleic acid editing polypeptide of any one of Embodiment 106-Embodiment 108, wherein said endonuclease is an endonuclease.

Embodiment 110. The engineered nucleic acid editing polypeptide of Embodiment 109, wherein said endonuclease is a Class II, type II endonuclease or a Class II, type V endonuclease.

Embodiment 111. The engineered nucleic acid editing polypeptide of Embodiment 106, wherein said endonuclease comprises a sequence having at least 70%, 80%, 90% or 95% sequence identity to any one of SEQ ID NOs:70-78 or 597, or a variant thereof.

Embodiment 112. The engineered nucleic acid editing polypeptide of any one of Embodiment 109-Embodiment 111, wherein said endonuclease comprises a nickase mutation.

Embodiment 113. The engineered nucleic acid editing polypeptide of Embodiment 112, wherein said endonuclease comprises the aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597.

Embodiment 114. The engineered nucleic acid editing polypeptide of any one of Embodiment 109-Embodiment 113 wherein said endonuclease is configured to bind to a protospacer adjacent motif (PAM) sequence selected from the group consisting of Sequence Numbers: A360-A368 or A598.

Embodiment 115. The engineered nucleic acid editing polypeptide of any one of Embodiment 106-Embodiment 114, wherein said base editor is an adenine deaminase.

Embodiment 116. The engineered nucleic acid editing polypeptide of Embodiment 115, wherein said adenosine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 50-51, 385-443, 448-475, or 595, or a variant thereof.

Embodiment 117. The engineered nucleic acid editing polypeptide of Embodiment 116, wherein said adenosine deaminase comprises a sequence with at least 70%, 80%, 90% or 95% identity to any one of SEQ ID NOs: 50-51, 385-390, or 595, or a variant thereof.

Embodiment 118. The engineered nucleic acid editing polypeptide of any one of Embodiment 106-Embodiment 114, wherein said base editor is a cytidine deaminase.

Embodiment 119. The engineered nucleic acid editing polypeptide of Embodiment 118, wherein said cytidine deaminase comprises a sequence with at least 70%, 80%, 90% or 95% identity to any one of SEQ ID NOs: 1-49, 444-447, or a variant thereof.

Embodiment 120. The engineered nucleic acid editing polypeptide of any one of Embodiment 106-Embodiment 119, further comprising a uracil DNA glycosylase inhibitor (UGI) coupled to said endonuclease or said base editor.

Embodiment 121. The engineered nucleic acid editing polypeptide of Embodiment 120, wherein said uracil DNA glycosylase inhibitor comprises a sequence with at least 70%, 80%, 90% or 95% identity to any one of SEQ ID NOs: 52-56 or SEQ ID NO: 67, or a variant thereof.

Embodiment 122. The engineered nucleic acid editing polypeptide of any one of Embodiment 106-Embodiment 121, wherein a polypeptide comprising said endonuclease comprises one or more nuclear localization sequences (NLSs) proximal to an N- or C-terminus of said endonuclease.

Embodiment 123. The engineered nucleic acid editing polypeptide of Embodiment 122, wherein said NLS comprises a sequence with at least 90% identity to a selected from SEQ ID NOs: 369-384, or a variant thereof.

Embodiment 124. The engineered nucleic acid editing polypeptide of any one of Embodiment 106-Embodiment 123, wherein said endonuclease is covalently coupled directly to said base editor or covalently coupled to said base editor through a linker.

Embodiment 125. A nucleic acid comprising an engineered nucleic acid sequence optimized for expression in an organism, wherein said nucleic acid encodes a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 1-51, 385-386, 387-443, 444-447, 488-475, or 595, or a variant thereof.

Embodiment 126. The nucleic acid of Embodiment 125, wherein said organism is prokaryotic, bacterial, eukaryotic, fungal, plant, mammalian, rodent, or human.

Embodiment 127. A vector comprising the nucleic acid of any of Embodiment 125-Embodiment 126.

Embodiment 128. The vector of Embodiment 127, wherein the vector is a plasmid, a minicircle, a CELiD, an adeno-associated virus (AAV) derived virion, or a lentivirus.

Embodiment 129. A cell comprising the vector of any one of Embodiment 127-Embodiment 128.

Embodiment 130. A method of manufacturing a base editor, comprising cultivating said cell of Embodiment 129.

Embodiment 131. A system comprising:

(a) the nucleic acid editing polypeptide of any one of Embodiment 106-Embodiment 124; and
(b) an engineered guide ribonucleic acid structure configured to form a complex with said nucleic acid editing polypeptide comprising:
    i. a guide ribonucleic acid sequence configured to hybridize to a target deoxyribonucleic acid sequence; and
    ii. ribonucleic acid sequence configured to bind to said endonuclease.

Embodiment 132. The system of Embodiment 131, wherein said engineered guide ribonucleic acid sequence comprises a sequence with at least 80% sequence identity to non-degenerate nucleotides of any one of SEQ ID NOs: 88-96, 488-489, or 679-680.

Embodiment 133. A method of modifying a target nucleic acid locus, said method comprising delivering to said target nucleic acid locus said engineered nucleic acid editing polypeptide of any one of embodiments Embodiment 106-Embodiment 124 or said system of any one of embodiments Embodiment 131-Embodiment 132, wherein said complex is configured such that upon binding of said complex to said target nucleic acid locus, said complex modifies a nucleotide of said target nucleic locus.

Embodiment 134. A nucleic acid editing polypeptide, comprising: an adenosine deaminase, comprising a polypeptide sequence comprising a substitution at at least one residue selected from the group consisting of residue 24, residue 83, residue 85, residue 107, residue 109, residue 112, residue 124, residue 143, residue 147, residue 148, residue 154, or residue 158 relative to SEQ ID NO: 386 when optimally aligned.

Embodiment 135. The nucleic acid editing polypeptide of Embodiment 134, wherein said residue substituted is selected from W24, V83, L85, A107, D109, T112, H124, A143, S147, D148, R154, and K158.

Embodiment 136. The nucleic acid editing polypeptide of Embodiment 134 or Embodiment 135, wherein said substitution is a conservative substitution.

Embodiment 137. The nucleic acid editing polypeptide of Embodiment 134 or Embodiment 135, wherein said substitution is a non-conservative substitution.

Embodiment 138. The nucleic acid editing polypeptide of any one of Embodiment 134-Embodiment 137, comprising a substitution at W24, wherein said substitution is W24R.

Embodiment 139. The nucleic acid editing polypeptide of any one of Embodiment 134-Embodiment 138, comprising a substitution at V83, wherein said substitution is V83S.

Embodiment 140. The nucleic acid editing polypeptide of any one of Embodiment 134-Embodiment 139, comprising a substitution at L85, wherein said substitution is L85F.

Embodiment 141. The nucleic acid editing polypeptide of any one of Embodiment 134-Embodiment 140, comprising a substitution at A107, wherein said substitution is A107V.

Embodiment 142. The nucleic acid editing polypeptide of any one of Embodiment 134-Embodiment 141, comprising a substitution at D109, wherein said substitution is D109N.

Embodiment 143. The nucleic acid editing polypeptide of any one of Embodiment 134-Embodiment 142, comprising a substitution at T112, wherein said substitution is T112R.

Embodiment 144. The nucleic acid editing polypeptide of any one of Embodiment 134-Embodiment 143, comprising a substitution at H124, wherein said substitution is H124Y.

Embodiment 145. The nucleic acid editing polypeptide of any one of Embodiment 134-Embodiment 144, comprising a substitution at A143, wherein said substitution is A143N.

Embodiment 146. The nucleic acid editing polypeptide of any one of Embodiment 134-Embodiment 145, comprising a substitution at S147, wherein said substitution is S147C.

Embodiment 147. The nucleic acid editing polypeptide of any one of Embodiment 134-Embodiment 146, comprising a substitution at D148, wherein said substitution is D148Y or D148R.

Embodiment 148. The nucleic acid editing polypeptide of any one of Embodiment 134-Embodiment 147, comprising a substitution at R154, wherein said substitution is R154P.

Embodiment 149. The nucleic acid editing polypeptide of any one of Embodiment 134-Embodiment 148, comprising a substitution at K158, wherein said substitution is K158N.

Embodiment 150. The nucleic acid editing polypeptide of any one of Embodiment 134-Embodiment 149, wherein said adenosine deaminase comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% sequence identity to any one of SEQ ID NOs: 50-51 or 385-443.

Embodiment 151. The engineered nucleic acid editing polypeptide of any one of Embodiment 134-Embodiment 150, further comprising an endonuclease, wherein said endonuclease is configured to be deficient in endonuclease activity.

Embodiment 152. The engineered nucleic acid editing polypeptide of Embodiment 151, wherein said endonuclease is configured to cleave one strand of a double-stranded target deoxyribonucleic acid.

Embodiment 153. The engineered nucleic acid editing polypeptide of Embodiment 151, wherein said endonuclease is configured to be catalytically dead.

Embodiment 154. The engineered nucleic acid editing polypeptide of any one of Embodiment 151-Embodiment 153, wherein said endonuclease is a Cas endonuclease.

Embodiment 155. The engineered nucleic acid editing polypeptide of Embodiment 154, wherein said endonuclease is a Class II, type II endonuclease or a Class II, type V endonuclease.

Embodiment 156. The engineered nucleic acid editing polypeptide of Embodiment 155, wherein said endonuclease comprises a sequence having at least 70%, 80%, 90% or 95% sequence identity to any one of SEQ ID NOs:70-78 or 597, or a variant thereof.

Embodiment 157. The engineered nucleic acid editing polypeptide of any one of Embodiment 151-Embodiment 156, wherein said endonuclease comprises a nickase mutation.

Embodiment 158. The engineered nucleic acid editing polypeptide of Embodiment 157, wherein said endonuclease comprises the aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597.

Embodiment 159. The engineered nucleic acid editing polypeptide of any one of Embodiment 151-Embodiment 156, wherein said endonuclease is configured to bind to a protospacer adjacent motif (PAM) sequence selected from the group consisting of Sequence Numbers: A360-A368 or A598.

SEQUENCE LISTING (1894 sequences)

SEQ ID NO: 1 - protein, 186 aa, unidentified
  source 1..186: note = MG66-2 deaminase
MARVLGLDPGFATCGYALVDLTRKDGAPFVDVRSLGTLRTAKADKKRKVLAADDNLRRAQELIRALYPLASNAQAIVAESMSFPRNSAAAAKMAMCWGIVATLAEMNDLPIVQATPKEIKIAVAGVGTATKEDVAAAVCAKCGRQFSEELLAQGLPKGMHEHAYDAVASVLACLNSDVLRAIRRAG

SEQ ID NO: 2 - protein, 164 aa, unidentified
  source 1..164: note = MG66-3 deaminase
MDRLSLHQYAIALAWVAATRSEDPYTRVGCVALSEQGNVLATAYNGLKPKATFGPEFWNNRESRLPFMVHAEMNLVSLTKRNEVHTVAINILPCPTCAAFLATHGVQQVVYSEVYHRDKGTVGLTVLREYGVEIHHLPYYRVRPVFLDMDEAHRKVRSEQRTAA

SEQ ID NO: 3 - protein, 135 aa, unidentified
  source 1..135: note = MG66-4 deaminase
MREYIQAARDEAAKSRCDRAHVGCVIVDRATGHVVSSAFNETPHGLEPCDTGGHRIVDNHCVNTVHAERNAIRKMTEHGSEYTLYVTHYPCQGCAHLIASCPEIVEVVYLGDYNNSSEATALLSGLSKGVHHGEE

SEQ ID NO: 4 - protein, 160 aa, unidentified
  source 1..160: note = MG66-5 deaminase
MSNTQSLHTTFMHILFEFSKLSHCVSKQVAAMAVKDGRIISTGINGTAPGYTNCDDIFNKSDFNRELHHQFSNTYEIHAEMNMILYAAKNGISLDGATLYCSMLPCWNCIKHISVTGIKHIIYAKRYDMLSLEDEKNIYYYCKKLGITIQQFDPDTLGSF

SEQ ID NO: 5 - protein, 124 aa, unidentified
  source 1..124: note = MG66-6 deaminase
MTSGILKLALEEAESSTYRFRVGAVVFKGSRILASGHNGIRSSRIHPLHKNYNNALHAEQDAILNVKDWSTLKGCSILVVKVSKTKGTISMAKPCPMCQQLLRHVGIKTMYFSNENGEIISEKL

SEQ ID NO: 6 - protein, 132 aa, unidentified
  source 1..132: note = MG66-7 deaminase
MTKREIAYFNAAKAVSSLSDHKYKMGCVIVNKHRIISSGFNSETKCHRIQAELDMNEYKMHSSGKVHAETSALLSLRHIDLSKASIFIYRELKDGTKALARPCPCCQKLIRKAGIKHVYYTGNNSLIYEEFI

SEQ ID NO: 7 - protein, 142 aa, unidentified
  source 1..142: note = MG66-8 deaminase
AAGDFVQVREYIKAARDEAAKSRCDRAHVGCVIVDRVTGRVVSRAFNETPHGLEPCDTGGHRMIDGHCVNTVHAERNAIRKMKEHESEYTLYVTHYPCQGCAHLIASCPEIVEVVYLGDYRNSKEATALLMGLSKGVHRGEE

SEQ ID NO: 8 - protein, 82 aa, unidentified
  source 1..82: note = MG66-9 deaminase
HRIVDNHCVNTVHAERNAIRKMKEHGSEYTLYVTHYPCQGCAHLISSCPEIVEVVYLGDYRNSSEATALLSGLSKGVHRGEE

SEQ ID NO: 9 - protein, 115 aa, unidentified
  source 1..115: note = MG66-10 deaminase
HVGCVIVDHATGQVVSSAFNETPPGLEPCDTGGHRIVDDHCVNTVHAERGAIRKMAEHGSEYTLYVTHYPCRGCAHLISSCPEIVEVVYLGDYNNSSEATDLLMSLSKGVHRAEE

SEQ ID NO: 10 - protein, 186 aa, unidentified; identical to SEQ ID NO: 1
  source 1..186: note = MG66-11 deaminase

SEQ ID NO: 11 - protein, 232 aa, unidentified
  source 1..232: note = MG66-12 deaminase
MDNLPKYEYLNVLDPERTGISETWLSYFMNIARVIATKSKDPSTKVGAVAVDTNTKRILATGYNGFPAGVKERPERWERPVKYSYIVHSEANIVASAARFGINLTGSTLFVTLHPCVDCAKIVASAGFKNVIYIDTEIKAQVGREWITLLQHSKNIFEESRIGLYACREVPAKKKEEPKLYKTYKGTVETTTELNNKRDKQLGDLVFVKSRNTLYEWNGVIWTVIGEYQHLL

SEQ ID NO: 12 - protein, 113 aa, unidentified
  source 1..113: note = MG66-13 deaminase
MDNLPKYEYLNVLDPERTRISETWLSYFMNIARVIATKSKDPSTKVGAVAVDTNTKRILATGYNGFPAGVKERPERWERPVKYSYIVHSEANIVASAARFGINLTGSTLFVTL

SEQ ID NO: 13 - protein, 232 aa, unidentified
  source 1..232: note = MG66-14 deaminase
MDNLPKYEYLNVLDPERTRISETWLSYFMNIARVIATKSKDPSTKVGAVAVDTNTKRILATGYNGFPAGVKERPERWERPVKYSYIVHSEANIVASAARFGINLTGSTLFVTLHPCVDCAKIVASAGFKNVIYIDTEIKPQVGREWITLLQHSKNIFEESRIGLYACREVPAKKKEEPKLYKTFKGTVETTVELNNKRDKQLGDLVFVKSRNTLYEWNGVIWTVIGEYQHLL

SEQ ID NO: 14 - protein, 164 aa, unidentified; identical to SEQ ID NO: 2
  source 1..164: note = MG66-15 deaminase

SEQ ID NO: 15 - protein, 50 aa, unidentified
  source 1..50: note = MG66-18 deaminase
MKQYIQAARDEAAKSRCDRAHVGCVIVDRATGQVVSRAFNETPHGLEPCD

SEQ ID NO: 16 - protein, 135 aa, unidentified
  source 1..135: note = MG66-19 deaminase
MKQYIQAARDEAAKSRCDRAHVGCVIVDRATGQVVSRAFNETPHGLEPCDTGGHRIVDNHCVNTVHAERNAIRKMKEHGSEYTLYVTHYPCQGCAHLISSCPEIVEVVYLGDYRNSSEATALLSGLSKGVHRGEE

SEQ ID NO: 17 - protein, 135 aa, unidentified
  source 1..135: note = MG66-20 deaminase
MKQYIQAARDEAAKSRCDRAHVGCVIVDRATGQVVSRAFNETPHGLEPCDTGGHRIVDNHCVNTVHAERNAIRQMKEHGSEYTLYVTHYPCQGCAHLISSCPEIIEVVYIGDYNNSSEATALLSGLSKGVHRGEE

SEQ ID NO: 18 - protein, 204 aa, unidentified
  source 1..204: note = MG66-21 deaminase
MNIARVIATKSKDPSTKVGAVAVDTNTKRILATGYNGFPAGVKERPERWERPVKYSYIVHSEANIVASAARFGINLTGSTLFVTLHPCVDCAKIVASAGFKNVIYIDTEIKPQVGREWITLLQHSKNIFEESRIGLYACREVPAKKKEEPKLYKTFKGTVETTVELNNKRDKQLGDLIFVRSRNTLYEWNGVIWTVIGEYQHLL

SEQ ID NO: 19 - protein, 142 aa, unidentified
  source 1..142: note = MG66-22 deaminase
MREFIKAARDEAAKSRCDRAHVGCVIVDRATGRVVSRAFNETPHGLEPCDTGGHRMIDGHCVNTVHAERGAIRKMQSHDSEYTLYVTHYPCQGCAHLIASCPDIVEVVYLGDYRNSNEATALLMGLSKGVHHAEEDCSSSPA

SEQ ID NO: 20 - protein, 142 aa, unidentified
  source 1..142: note = MG66-23 deaminase
MREFIKAARDEAAKSRCDRAHVGCVIVDRATGRVVSRAFNETPHGLEPCDTGGHRMIDGHCVNTVHAERGAIRKMQSHDSEYTLYVTHYPCQGCAHLIASCPEIVEVVYLGDYRNSNEATALLMGLSKGVHHAEEDCSSSPA

SEQ ID NO: 21 - protein, 142 aa, unidentified
  source 1..142: note = MG66-24 deaminase
MREFIKAARDEAAKSRCDRAHVGCVIVDRATGRVVSRAFNETPHGLEPCDTGGHRMIDGHCVNTVHAERGAIRKMQTHDSEYTLYVTHYPCQGCAHLIASCPEIVEVVYLGDYRNSNEATALLMGLSKGVHHAEEDCSSSPA

SEQ ID NO: 22 - protein, 142 aa, unidentified
  source 1..142: note = MG66-25 deaminase
MREFIKAARDEAAKSRCDRAHVGCVIVDRATGRVVSRAFNETPHGLEPCDTGGHRMIDGHCVNTVHAERGAIRKMTSHDSEYTLYVTHYPCQGCAHLIASCPEIVEVVYLGDYRNSNEATALLMGLSKGVHHAEEDCSSSPA

SEQ ID NO: 23 - protein, 136 aa, unidentified
  source 1..136: note = MG66-26 deaminase
MRELGIKAARDEAKKSRCDRAHVGCVIIDRASGQVVSRAFNETPPTLEPCDTGGHRMVDGHCVNTVHAERGAIRKMAEHGSEYTLYVTHYPCRGCAHLISSCPEIVEVVYLGDYNNSSEATALLMSLSKGVHRVKG

SEQ ID NO: 24 - protein, 135 aa, unidentified
  source 1..135: note = MG66-27 deaminase
MREYIKAARDEAAKSRCDRAHVGCVIVDHATGQVVSRAFNETPHGLEPCDTGGHRIVDNHCVNTVHAERNAIRKMKEHGSEYTLYVTHYPCRGCAHLISTCPEIVEVVYLGDYNNSSEATALLEGLSKGVHRGEE

SEQ ID NO: 25 - protein, 135 aa, unidentified
  source 1..135: note = MG66-28 deaminase
MREYIKAARDEAAKSRCDRAHVGCVIVDRATEQVVSRAFNETPNGLEPCDTGGHRIVDDHCVNTVHAERNAIRKMREHGSEYTLYVTHYPCQGCAHLISSCPEIVEVVYLGDYNNSSEATALLSGLSKGVHRGEE

SEQ ID NO: 26 - protein, 36 aa, unidentified
  source 1..36: note = MG66-29 deaminase
MREYIKAARDEAAKSRCDRAHVGCVIVDRATGQVVS

SEQ ID NO: 27 - protein, 135 aa, unidentified
  source 1..135: note = MG66-30 deaminase
MREYIKAARDEAAKSRCDRAHVGCVIVDRATGQVVSGAFNETPHGLEPCDTGGHRIVDGHCVNTVHAERNAIRKMKEHGSEYTLYVTHYPCRGCAHLISSCPEIVEVVYLGDYNNSSEATALLSGLSKGVHRGEE

SEQ ID NO: 28 - protein, 135 aa, unidentified
  source 1..135: note = MG66-31 deaminase
MREYIKAARDEAAKSRCDRAHVGCVIVDRATGQVVSRAFNETPHGLEPCDTGGHRIVDNHCVNTVHAERNAIRKMKEHGSEYTLYVTHYPCQGCAHLISSCPEIVEVVYLGDYRNSSEATALLSGLSKGVHRGEE

SEQ ID NO: 29 - protein, 135 aa, unidentified
  source 1..135: note = MG66-32 deaminase
MREYIKAARDEAAKSRCDRAHVGCVIVDRATGQVVSRAFNETPHGLEPCDTGGHRIVDNHCVNTVHAERNAIRKMTDHGSEYTLYVTHYPCQGCAHLISSCPEIVEVVYLGDYNNSSEATALLSGLSKGVHRGEE

SEQ ID NO: 30 - protein, 135 aa, unidentified
  source 1..135: note = MG66-33 deaminase
MREYIKAARDEAAKSRCDRAHVGCVIVDRATGQVVSRAFNETPHGLEPCDTGGHRMVDDHCVNTIHAERNAIRQMKEHGSEYTLYVTHYPCRGCAHFISTCPEIVEVVYLGDYRNSSEATALLSGLSKGVHRGEE

SEQ ID NO: 31 - protein, 40 aa, unidentified
  source 1..40: note = MG66-34 deaminase
MREYIKAARDEAAKSRCDRAHVGCVIVDRATGQVVSSAFN

SEQ ID NO: 32 - protein, 135 aa, unidentified
  source 1..135: note = MG66-35 deaminase
MREYIKAARDEAAKSRCDRAHVGCVIVDRATGQVVSSAFNETPHGLEPCDTGGHRIVDNHCVNTVHAERNAIRQMTDHGSEYTLYVTHYPCQGCAHLIASCPEIVEVVYLGDYNNSSEATALLSGLSKGVHRGEE

SEQ ID NO: 33 - protein, 142 aa, unidentified
  source 1..142: note = MG66-36 deaminase
MREYIKAARDEAAKSRCDRAHVGCVIVDRATGRVVSRAFNETPHGLEPCDTGGHRMIDGHCVNTVHAERNAIRKMPSHDSEYTLYVTHYPCQGCAHLIASCPDIVEVVYLGDYRNSEEATALLMGLSKGIHCAEEDRSSSPA

SEQ ID NO: 34 - protein, 142 aa, unidentified
  source 1..142: note = MG66-37 deaminase
MREYIKAARDEAAKSRCDRAHVGCVIVDRATGRVVSRAFNETPHGLEPCDTGGHRMIDGHCVNTVHAERNAIRKMPSHDSEYTLYVTHYPCQGCAHLIASCPDIVEVVYLGDYRNSEEATALLMGLSKGVHCAEEDRSSSPA

SEQ ID NO: 35 - protein, 135 aa, unidentified
  source 1..135: note = MG66-38 deaminase
MREYIKAARDEAKKSRCDRAHVGCVIVDRASGQVVSSAFNETPPGLEPCDTGGHRMVDDHCVNTVHAERGAILKMAEHGSEYTLYVTHYPCRGCAHLISSCPEIVEVVYLGDYNNSSEATTLLMSLSKGVHHVEG

SEQ ID NO: 36 - protein, 135 aa, unidentified
  source 1..135: note = MG66-39 deaminase
MREYIKAARDEAKKSRCDRAHVGCVIVDRATGQVVSKGFNETPPGLEPCDTGGHHIVDNHCVNTVHAERSAIRKMTEHGSEYTLYVTHYPCRGCAHLITSCPEIMEVVYLGDYNNSSEATELLMGLSKGVHHVEG

SEQ ID NO: 37 - protein, 135 aa, unidentified
  source 1..135: note = MG66-40 deaminase
MREYIKAARDEAKKSRCDRAHVGCVIVDRATGRVVSRAFNETPHGLEPCDTGGHRIVDDHCVNTVHAERNAIRRMVEHGSEYTLYVTHYPCQGCAHLISSCPEIVEVVYLGDYNNSSEATALLSGLSKGVHRGEE

SEQ ID NO: 38 - protein, 135 aa, unidentified
  source 1..135: note = MG66-41 deaminase
MREYIQAARDEAKKSRCDRAHVGCVIVDRASGQVVSSAFNETPPGLEPCDTGGHRMVDGHCVNTVHAERGAIRKMAEHGSEYTLYVTHYPCRGCAHLISSCPEIMEVVYLGDYNNSSEATTLLMGLSKGVHHVEE

SEQ ID NO: 39 - protein, 135 aa, unidentified
  source 1..135: note = MG66-42 deaminase
MREYIQAARDEAKKSRCDRAHVGCVIVDRATGRVVSSAFNETPPGLEPCDTGGHRMVDGHCVNTVHAERGAIRKMAEHGSEYTLYVTHYPCRGCGHLISSCPEIVEVVYLGDYNNSSEATALLMGLSKGVHHVEE

SEQ ID NO: 40 - protein, 135 aa, unidentified
  source 1..135: note = MG66-43 deaminase
MREYIQAARDEASKSRCDRAHVGCVIVDRATGQVVSRAFNETPHGLEPCDTGGHRIVDNHCVNTIHAERNAIRKMPTHDSEYTLYVTHYPCQGCAHLISSCPEIVEVVYLGDYRNSSEATALLSGLSKGVHRGEE

SEQ ID NO: 41 - protein, 135 aa, unidentified
  source 1..135: note = MG66-44 deaminase
MREYIRAARDEAAKSRCDRAHVGCVIVDRATGQVVSRAFNETPHGLEPCDTGGHRIVDNHCVNTVHAERNAIRKMTEHGSEYTLYVTHYPCQGCAHLISSCPEIVEVVYLGDYNNSSEATALLEGLSKGVHRGEE

SEQ ID NO: 42 - protein, 135 aa, unidentified
  source 1..135: note = MG66-45 deaminase
MREYIRAARDEAAKSRCDRAHVGCVIVDRATSRVVSRAFNETPHGLDPCDTGGHRMIDGHCVNTVHAERNAIRKMPSHDSEYTLYVTHYPCQGCAHLIASCPDIVEVVYLGDYRNSKEATALLMGLSKGIHHAEE

SEQ ID NO: 43 - protein, 151 aa, unidentified
  source 1..151: note = MG66-46 deaminase
MRVRPDWDTYFMRIAKVVAQRSHDEDTQVGCVIVSPDKRILSTGYNGFPPGFPDGKLPRTRPGKYPYIVHSEINAIVSALNRDLRGATLYCRFTPCKDCVKAIITAGITRIVYEETYARDNTDAAVVFEMLEMGGVEIVKHLEHEHEADSD

SEQ ID NO: 44 - protein, 159 aa, unidentified
  source 1..159: note = MG66-47 deaminase
MSNTQSLHTTFMHILFEFSKLSHCVSKQVAAMAVKDGRIISTGINGTAPGYTNCDDIFNKSDFDRELHHQFSNTYEIHAEMNMILYAAKNGISLDGATLYCSMLPCWNCIKHISVTGIKHIIYAKRYDMLSLEDEKNIYYYCKKLGITIQQFDPDTLGS

SEQ ID NO: 45 - protein, 160 aa, unidentified
  source 1..160: note = MG66-48 deaminase
MSNTQSLHTTFMHILFEFSKLSHCVSKQVAAMAVKDGRIISTGINGTAPGYTNCDDIFNKSDFDRELHHQFSNTYEIHAEMNMILYAAKNGISLDGATLYCSMLPCWNCIKHISVTGIKHIIYAKRYDMLSLEDEKNIYYYCKKLGITIQQFDPDTLGSF

SEQ ID NO: 46 - protein, 124 aa, unidentified; identical to SEQ ID NO: 5
  source 1..124: note = MG66-49 deaminase

SEQ ID NO: 47 - protein, 80 aa, unidentified
  source 1..80: note = MG66-50 deaminase
MVDGHCVNTVHAERGAIRKMTEHGSEYTLYVTHYPCRGCAHLISSCPEIVEVVYLGDYNNSSEATALLMGLSKGVHHVEG

SEQ ID NO: 48 - protein, 150 aa, unidentified
  source 1..150: note = MG67-2 deaminase
MTACKDKPVCNVAQADATLLSTCLRLLQTAHEIKQNAYAPYSGFQVGAAVLAKNGSIITGVNVENGSLGLTICAERTALSKAVSEGYRPGDFVAIAVAASADGFSPCGACREVINEFGQNMLVVFEYQDEVVVAPLKTLLAYNFVKGKPS

SEQ ID NO: 49 - protein, 62 aa, unidentified
  source 1..62: note = MG67-4 deaminase
MAYRPGDFVAIAIAASSPDFSPCGACREVINEFGDDMAVIFEIKGETVVSQLKEHLPYNFKM

SEQ ID NO: 50 - protein, 250 aa, unidentified
  source 1..250: note = MG68-1 deaminase
MQHVKHMRTAVRLARYALDHDETPVACIFVHTPTGQVMAYGMNDTNKSLTGVAHAEFMGIDQIKAMLGSRGVVDVFKDITLYVTVEPCIMCASALKQLGIGKVVFGCGNERFGGNGTVLSVNHDTCTLVPKNNSAAGYESIPGILRKEAIMLLRYFYVRQNERAPKPRSKSDRVLDKNTFPPMEWSKYLNEEAFIETFGDDYKTCFANKVDLSSNSVDWDLIDSHQDNIIQELEEQCKMFRFNVHKKSKV

SEQ ID NO: 51 - protein, 239 aa, unidentified
  source 1..239: note = MG68-2 deaminase
MLLNKRSYGHFYFIALMTEFSKWDEYYMKLALMEAEKALNSNEVPIGCVFVKSDTEVEIPPLPSRYSKDEFHSSVIASGRNFTNENYNATHHAEIMALTDLISCLECNCKKIDNMGEPCKPTFSKDTECPQCNFNLKNVTLYVTIEPCIMCISALMELQVSRIVFGANNDKFGGCGGTLTNVPEILKDTCSKDFEEIKIERGLYREEAVILLRKFYLIQNPKAPNPKKKAKRTLNLIVD

SEQ ID NO: 52 - protein, 87 aa, unidentified
  source 1..87: note = MG69-1 deaminase
MSKTIKDLEEFAAEKLGYDIVFQESISMEPQEVEHLITTDEKSVLVNSTYDDNKEITISMISTPHPEYRPIALIIQDMEGEVQRKEL

SEQ ID NO: 53 - protein, 88 aa, unidentified
  source 1..88: note = MG69-2 deaminase
MSKTIKDLEEFAAEKLGYDIVFQESISMEPQEVEHLITTDEKSVLVNSTYDDDKEITISVISTPHPEYRPIALVIQDMEGEVQRKELY

SEQ ID NO: 54 - protein, 84 aa, unidentified
  source 1..84: note = MG69-3 deaminase
MTNLSDIIEKETGKQLVIQESILMLPEEVEEVIGNKPESDILVHTAYDESTDENVMLLTSDAPEYKPWALVIQDSNGENKIKML

SEQ ID NO: 55 - protein, 67 aa, unidentified
  source 1..67: note = MG69-4 deaminase
MIVRVTYNVEQEVEISNKFNKDVDIMKPEEYDDYIDDLMFALNEKLPEYAEISCVINDNTGEVLFEG

SEQ ID NO: 56 - protein, 35 aa, unidentified
  source 1..35: note = MG69-5 deaminase
MSKTIKDLEEFAAEKLGYDIVFQESISMEPQEVEH

SEQ ID NO: 57 - protein, 167 aa, Escherichia coli
  source 1..167: note = P68398 TADA tRNA specific adenosine deaminase
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 58 - protein, 229 aa, Rattus norvegicus [sequence omitted]

SEQ ID NO: 59 - protein, 251 aa, Heterocephalus glaber
  source 1..251: note = Aicda XM 004869540 cytidine deaminase
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGL

SEQ ID NO: 60 - protein, 224 aa, Petromyzon marinus
  source 1..224: note = PmCDA1 L1 AVN88313.1 cytidine deaminase
MAGYECVRVSEKLDFDTFEFQFENLHYATERHRTYVIFDVKPQSAGGRSRRLWGYIINNPNVCHAELILMSMIDRHLESNPGVYAMTWYMSWSPCANCSSKLNPWLKNLLEEQGHTLTMHFSRIYDRDREGDHRGLRGLKHVSNSFRMGVVGRAEVKECLAEYVEASRRTLTWLDTTESMAAKMRRKLFCILVRCAGMRESGIPLHLFTLQTPLLSGRVVWWRV

SEQ ID NO: 61 - protein, 208 aa, Petromyzon marinus
  source 1..208: note = PmCDA1 ABO15149.1 cytosine deaminase
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 62 - protein, 199 aa, Homo sapiens
  source 1..199: note = NP 663745.1 DNA dC- dU-editing deaminase APOBEC-3A isoform a
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 63 - protein, 198 aa, Homo sapiens [sequence omitted]

SEQ ID NO: 64 - protein, 197 aa, Lampetra planeri
  source 1..197: note = LpCDA1L1 3 AVN88320.1 cytidine deaminase
MAGDENVRVSEKLHFNTFEFEFENLHYAEGRGQTYVIFDVKPQSEGGRGERLWGYVRNKPLGDHAEVILMSKINDHLETHQDNYTMTWYMSWSPCGKCSSELVPWLQNLLKKQHKLTMHFSRIYDKDRAVDHRGLCDLQHVVSNGFQMGVMGQTEVDTCLAEYVEASGCPPLKWLHMTDSNATQMQDKLSSILMNRF

SEQ ID NO: 65 - protein, 198 aa, Lampetra planeri
  source 1..198: note = LpCDA1L1 1 AVN88319.1 cytidine deaminase
MAGDENVRVSKKLDFNTFEFEFENLHYAEGRGRTYVIFDVKPQSEGGRGERLWGYVRNNPLDDHAEVILMSKINDHLETHQGNYTMTWYMSWSPCGNCSSELVPWLQNLLEEQQHTLTMYFSRIYDKDRAVDHRGLCDLQHVVSNGFQMGVMGQTEVDTCLAEYVEASGCPPLKWLHMTDSNATQTQDKLSSILMNRF

SEQ ID NO: 66 - DNA, 642 bp, Lampetra planeri
  source 1..642: mol_type = genomic DNA; note = ljCDA1 cytidine deaminase
gccaacgccgagtacgtgcgcgtgggcgagaagctggacagctgcaccttccgcacccagttcctgaactaccgccgcagccgcagccgccgctgctgcgtgatcttcgagctgaagcgccagaacagccgcgtgcgcttctggggctacgccatgaacaagccctggagcaacgccgacgtgggcatccacgccgagttcttctgcatcaagaaggtgaagaagtacctgcgcaagaaccccggcatctacaccatcaactggtacagcagctggagcccctgcgccaactgcgccgagaagatcctgaactggtacaacaagaagctgatgggcaagggccacaccctgaagatttgggcctgcaagctgtacttcgagaacatcaagcgcaaccagatcggcctgtggaacctgcgcaacaacggcgtgggcctggccatcatgctgggcgagcactaccagtggtgctggaacaactacatccagaccctgggccgcaacctgaacgagaacaagtggctgaaaaagaccagcaaccgcgcccgcacccgccgcagcgagctgagcatcatgatccacgtgaagcgcctgcacaccgcccgcctgctgctgttcaagcgcctgtgcggctggttcagc

SEQ ID NO: 67 - protein, 84 aa, unidentified; identical to SEQ ID NO: 54
  source 1..84: note = P14739 UNGI BPPB2 (UGI)

SEQ ID NO: 68 - protein, 1245 aa, synthetic construct
  source 1..1245: note = linker-His tag-adenine deaminse-linker-nickase-linker-SV40 NLS
MGSSHHHHHHSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSMKKKVFAFALGKASIGYCVRDGFNINEANSIIIDKDHAETMSLRDRRRIKKTLDAHHAREEYFNKVWSGVGLNILDKNNNNFKKEFPSKNEDVIYTSCLLRIALLQNQKLEEWQIYKALYNAFQRRGYDVNIAWKSVQTDDDKENIERMKKYTCENDIELIISDEYKYPCYYDALRLGLWNEDEPTKLNRSIPQHNSNKVRTTEYVAPRELVEKELKQLWLNAQLQLPQLNSISAEEFLYGEYKIPYGSCVQKEFKQYRGTKKDWQGVLCQKIPRFDNRIIAKCKLLPKRNVCKANTIENVSFVLLMKLKNLRFTVISGEKLRLSPVQIKQIYENWLEKVEDTYNKDLEKAEKLGKENPEKRLNITITRQEIEKIIGEKIIDKIEPMKADISGRSSFCRRACQIMNKIILDGELYPQNVDISEFVDRDNAKNGITEEEIQSMLSKIGDWNNLYIPDNREENAQNASNSRIKTDIMLGNITNPIVRNRLQIFRDLLLNLAEKYGTPDEVIFEFVRDGADNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGLAETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDKPFKGNTKPLETIYGLRTYGDKSYITQRVELNSIDKKATKIKSIIDETIKNDLLNKLKENPTEQEWKLMLQNYIHPKKQTKVKKVMISVSEGEITKDSNNRERMGEFVDFGTKGTQHQFKHSKRHKGQILYFNEKGVVEVMPVYSNIKTTDVKDKLQNMGCKLYNKGQMFYSGCLVDIPKPFKAGSKEYPAGRYQIKTIRSDKVAELEDACGNKISTNVKYLVPAEFKKVESKGSGGSPKKKRKV

SEQ ID NO: 69 - protein, 1380 aa, synthetic construct
  source 1..1380: note = linker-His tag-cytidine deaminase-linker-nickase-linker-uracil glycosylase inhibitor-linker-SV40 NLS
MGSSHHHHHHMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESAMKKKVFAFALGKASIGYCVRDGFNINEANSIIIDKDHAETMSLRDRRRIKKTLDAHHAREEYFNKVWSGVGLNILDKNNNNFKKEFPSKNEDVIYTSCLLRIALLQNQKLEEWQIYKALYNAFQRRGYDVNIAWKSVQTDDDKENIERMKKYTCENDIELIISDEYKYPCYYDALRLGLWNEDEPTKLNRSIPQHNSNKVRTTEYVAPRELVEKELKQLWLNAQLQLPQLNSISAEEFLYGEYKIPYGSCVQKEFKQYRGTKKDWQGVLCQKIPRFDNRIIAKCKLLPKRNVCKANTIENVSFVLLMKLKNLRFTVISGEKLRLSPVQIKQIYENWLEKVEDTYNKDLEKAEKLGKENPEKRLNITITRQEIEKIIGEKIIDKIEPMKADISGRSSFCRRACQIMNKIILDGELYPQNVDISEFVDRDNAKNGITEEEIQSMLSKIGDWNNLYIPDNREENAQNASNSRIKTDIMLGNITNPIVRNRLQIFRDLLLNLAEKYGTPDEVIFEFVRDGADNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGLAETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDKPFKGNTKPLETIYGLRTYGDKSYITQRVELNSIDKKATKIKSIIDETIKNDLLNKLKENPTEQEWKLMLQNYIHPKKQTKVKKVMISVSEGEITKDSNNRERMGEFVDFGTKGTQHQFKHSKRHKGQILYFNEKGVVEVMPVYSNIKTTDVKDKLQNMGCKLYNKGQMFYSGCLVDIPKPFKAGSKEYPAGRYQIKTIRSDKVAELEDACGNKISTNVKYLVPAEFKKVESKGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 70 - protein, 1025 aa, synthetic construct
  source 1..1025: note = nMG1-4 (D9A) nickase
MKKKVFAFALGKASIGYCVRDGFNINEANSIIIDKDHAETMSLRDRRRIKKTLDAHHAREEYFNKVWSGVGLNILDKNNNNFKKEFPSKNEDVIYTSCLLRIALLQNQKLEEWQIYKALYNAFQRRGYDVNIAWKSVQTDDDKENIERMKKYTCENDIELIISDEYKYPCYYDALRLGLWNEDEPTKLNRSIPQHNSNKVRTTEYVAPRELVEKELKQLWLNAQLQLPQLNSISAEEFLYGEYKIPYGSCVQKEFKQYRGTKKDWQGVLCQKIPRFDNRIIAKCKLLPKRNVCKANTIENVSFVLLMKLKNLRFTVISGEKLRLSPVQIKQIYENWLEKVEDTYNKDLEKAEKLGKENPEKRLNITITRQEIEKIIGEKIIDKIEPMKADISGRSSFCRRACQIMNKIILDGELYPQNVDISEFVDRDNAKNGITEEEIQSMLSKIGDWNNLYIPDNREENAQNASNSRIKTDIMLGNITNPIVRNRLQIFRDLLLNLAEKYGTPDEVIFEFVRDGADNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGLAETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDKPFKGNTKPLETIYGLRTYGDKSYITQRVELNSIDKKATKIKSIIDETIKNDLLNKLKENPTEQEWKLMLQNYIHPKKQTKVKKVMISVSEGEITKDSNNRERMGEFVDFGTKGTQHQFKHSKRHKGQILYFNEKGVVEVMPVYSNIKTTDVKDKLQNMGCKLYNKGQMFYSGCLVDIPKPFKAGSKEYPAGRYQIKTIRSDKVAELEDACGNKISTNVKYLVPAEFKKVESK

SEQ ID NO: 71 - protein, 1059 aa, synthetic construct
  source 1..1059: note = nMG1-6 (D13A) nickase
MEKEKNNHVWGFAIGKGSLGEAVRVGGDFKHIASVLLDPEFGEIKTAALARRQMRTRKAHKAREKWLEECLDGTGVEILKRREVGIVDGQWRLISKGDERLEREFPPNGEEVCYNSIALRCKLLLGEKLEGWQVFKALNSAIQKRGYDENIPWGEAEEKSSKKDEDDYAQKLSQYEREKSELFESFADGEKYDFPCFFKAYKMGLWSPENPRRVEVRIDCRAQKAKSYVVARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIASGAKYKMTKTAMKKFLKSISATALGDDYAEIEPPKESGRASFSRPAMDILKELIFSGMPPREFYGRKIPEISNTDKNKGVVASDLDFIKLMGDCPWGGIFIPDVQTYQFANAAFPNPDAQINKLIGSQNNPIVRHRLTFFFERIKFLESKYGVPDKVVLEFVRDDFMGEKEKKEMRIAMKKRAEEKMMIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNAAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVLRVLVYYGEADEYKDLSKDGCGAYRKGDGHKGQVVWESVDGKYYVEPVYVHASKAGVMAALNANPKKKRICGMFNSHCTVDVGDVYNDRGDFILPAGRYMVNTILTTGRCVLTNADGEKRNPININYLMRAGMRRVELSEL

SEQ ID NO: 72 - protein, 1134 aa, synthetic construct
  source 1..1134: note = nMG3-6 (D13A) nickase
MSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEG

SEQ ID NO: 73 - protein, 1131 aa, synthetic construct
  source 1..1131: note = nMG3-7 (D12A) nickase
MSEHTKYRIGIAVGDRSVGLAAIEFDDDGFPLSNLAMVTYRHDGGLDPTTNKSPKSRKETRGVALRTMRMRRRKKSRLKDLDKTLRALGYVVPACEEPQTYEAWKSRALLATTKVEGAQELGEHLVRAVRHMARHRGWRNPWWTFNQLEIASTAPSDTFAKIRERAEKEWPGVVPEEATLGMIGALAASNNVLLRPRTYRKDQPRHSKKLNVLGQEPILVDKVRQEDLLAELRTICKKQDIEDQYEKLAQAVFEQTRPYVPLDRVGKDPLQPNKSRASRASLEFQRFRILDAVAHLRVRVGASDRRALTDEEHDKAVHFLMGYSKKDVPTWGDVADEIGVEPAHLIAPVIDDVRLNKAPYDRSSTEFEQKMKKKTRARQWWDEANLESRSQLILLVSDPTDETMRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGCPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSLASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRPQNGSVHLDTVDAVLERTIGDAWTVDQVHRIVNPQIYLAFAGYLGNQKALDPDSSRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGGSYRPVSLDIQRAALAALDEQE

SEQ ID NO: 74 - protein, 1132 aa, synthetic construct
  source 1..1132: note = nMG3-8 (D13A) nickase
MSTDMKNYRIGVAVGDRSVGLAAIEFDDAGFPIQKLALVTFRHDGGLDPTDNPKSRKETRGEARRRMRMTRRRKQRLRDLDKVLENLGYTVPEGPEPETYEAWTSRALLASIKLASADELNEHLVRAVRHIARHRGWVNPWWSLDQLERASQEPSETFEIILARARELFGERVPANPTLGMLGALAANNEVLLRPRAEKKKKTGYVRGTPLLAAQVRQIDQVAELRRICEVQGIEEQYETLRNAIFAHKVAYVPTERVGKDPLAPSKNRTIRASLEFQEFRILDSVANLRVRTDSRAKRELTEGEYDAAVEFLMGYTAKEQPSWADVAEEIGVPGNRLIAPVLEDVQQKTAPFDRSSAAFEKAMSKRTEARQWWEANDDDQLRSLFIMFLADATNDTEEAAAVAGLPELYMSWPAEEREALSNIDFEKGRVAYSHETLSKLSEYMHEHRVGLHEARKAVFGVDDTWRPPLAKLEEPTGQPTVDRVLTILRRFVLDCERQWGRPRAITVEHARIGLVGPAQRQNILKEQEDNRKNNECIRDELRKSGVENPSRTEVRRHLVVQDQESQCLYCGAVIRTDTSELDHIVPRAGGGSSRRENLAAVCRYCNSKKDRTLFYDWAGSVRLQETIDRVRQLKAFKDSKKAKMFKNQIRRLRQTEADEPIDERSLASTSYAAVAVRERLEQHFNEGLAPDDKNRVVLDVYAGSVTRESRRAGGIDERILLRGERDKNRFDVRHHAIDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEG

SEQ ID NO: 75 - protein, 1055 aa, synthetic construct
  source 1..1055: note = nMG4-5 (D17A) nickase
MGDQQTLQATSYCLGLAVGVQGVGWAVIDLDDQGQPLGVRRTGVRCFDSGVGSETEFEKGVDEPPSTKRRQARQQRRQLWRRAQRQRRVFRALQEAGLLPPGPPTPVSRDKILRTLDADLAIQFGSLEDRIAAHLLPYRLRALALDTPLPPYALGRAFYHLAQRRGFLSNKKALKEEKEAGEVKKGIAELQEEMNRAGARALGEYFSSLDPEQRRIRNRWTARQMYLDEFDRVWEAQSRYHPRLTDELKTKVRRAIFFQRPLKSQKGLIGRCELEPRHRRAPLASLLAQRFRYWQKINDLEVIQPDGVVRPLSPEERHKLAHFLETQAEATFARIRKLLDLKKPKGSQEDFAFNLERGGEKRILGNRTAAKMAAVLGQRWAAMDDEDKRRLVNEILSFEKEAPLARRLVRAWNLDEPTAAQLAALDFEPGYAALSARAIRKLLPLMQREGMRFATARKQVYGDHLLGTRAYDALPPVAKAIPSLRNPAVCRALTEVRKVVNALVRAYGKPAMVRIELARDMKRGRKQRKETWQAMRENERCRLDARKLLQDHGIQEPRPADILKVLLAEECNWECPYTGKAISMDALIGSQPQFDVEHIIPFSRSLDNSFLNKTLCYHEENRNVKQNRTPFEAYGGDEQRWHEILQRVRRFRGSAAESKLRKFQLRQLPADFTNRHLNDTRYASRLAADYLALLYGGRVDANGRQRVQVGTGATTGFLRDEWGLNAILGDNDEKERADHRHHAIDAVVIALTGPGTVQALTRAALRAKELGRRLFVPLDPPWADRDSFLRDVRASVEAITVSYRVDRKVSGQLHEESNYSKPHMTVDNKGNLVEHRHIRKPLKDMSVEEVEAIVDDRVRKLVQEKLRQLGQEPKKAFADEANHPYFTTADGRLVPIHKARIRKTVATITVGPPQCPRHVAPGLNHHIEILAVRDPAGAVTHWEGELVSLFEAARRVKAGEPVVRRNHGPNKDFLFSLAKGEYVEMELQPGKRQLFRVTVISAKQIEFRLHHDARPTMLLRKTPGARVIRSPGSLFKAKARKVAVDPLGNVFPAND

SEQ ID NO: 76 - protein, 1003 aa, synthetic construct
  source 1..1003: note = nMG14-1 (D23A) nickase
MEITINREIGKLGLPRHLVLGMAPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKYVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 77 - protein, 1082 aa, synthetic construct
  source 1..1082: note = nMG15-1 (D8A) nickase
MNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 78 - protein, 1348 aa, synthetic construct
  source 1..1348: note = nMG18-1 (D12A) nickase
MDQSKEYYIGLAGGTDSVGWAVLNPDYTVVKKRGKSLWGVRLFESGQTAAERRLARSARRRTDRKKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEERFSLLQYAYAAYNWAVFARLLPEGKTISEVKTEEYEAYKADLRALKQLVKQYASDQYYRVFRSAKIKGNYASYVGKTNCGNEKSNPESCKPEEFFAFLKKELKPLWSQNIPAAASLAAKLESGTLLRRQRSGENAAIPYQAHLQELQIILKNMQQFYPFLQKADENGFTPAYKIEKLLTFRIPYYVGPLNDAHKEKGFCWIVKKADVPVLPWNFDQVVDENACEDAFIGRMSATCTYLVGENVLPQNSPLYCRFMVLNELNNLRIRSEKITPALKQAIFTQLFCAGKGGKVTQKKLLDFLHSQGIDANKQDISGIDGDFKASMAPAVKLQSIFTEPLPPEILERLAFALTVSGESHKMLQNRIRAILPNADNAVIRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGVSPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQTMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQRDPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGAAHAGILLASKNIDGKVPVSIVHQSVTGYFTQEVCLNDL

SEQ ID NO: 79 - DNA, 37 bp, synthetic construct
  source 1..37: mol_type = other DNA; note = nMG1-4 (D9A) protospacer and PAM for in vitro nickase assay
ccgtgagccaccacgtcgcaagcctcgaccaggaagg

SEQ ID NO: 80 - DNA, 38 bp, synthetic construct
  source 1..38: mol_type = other DNA; note = nMG1-6 (D13A) protospacer and PAM for in vitro nickase assay
tccgtgagccaccacgtcgcaagcctcgactagaacgg

SEQ ID NO: 81 - DNA, 32 bp, synthetic construct
  source 1..32: mol_type = other DNA; note = nMG3-6 (D13A) protospacer and PAM for in vitro nickase assay
agccaccacgtcgcaagcctcgacgtgggtta

SEQ ID NO: 82 - DNA, 31 bp, synthetic construct
  source 1..31: mol_type = other DNA; note = nMG3-7 (D12A) protospacer and PAM for in vitro nickase assay
agccaccacgtcgcaagcctcgacgtgttac

SEQ ID NO: 83 - DNA, 32 bp, synthetic construct; identical to SEQ ID NO: 81
  source 1..32: mol_type = other DNA; note = nMG3-8 (D13A) protospacer and PAM for in vitro nickase assay

SEQ ID NO: 84 - DNA, 29 bp, synthetic construct
  source 1..29: mol_type = other DNA; note = nMG4-5 (D17A) protospacer and PAM for in vitro nickase assay
agccaccacgtcgcaagcctcgacggcca

SEQ ID NO: 85 - DNA, 40 bp, synthetic construct
  source 1..40: mol_type = other DNA; note = nMG14-1 (D23A) protospacer and PAM for in vitro nickase assay
tccgtgagccaccacgtcgcaagcctcgacggcggggacg

SEQ ID NO: 86 - DNA, 37 bp, synthetic construct
  source 1..37: mol_type = other DNA; note = nMG15-1 (D8A) protospacer and PAM for in vitro nickase assay
ccgtgagccaccacgtcgcaagcctcgactggacctg

SEQ ID NO: 87 - DNA, 32 bp, synthetic construct
  source 1..32: mol_type = other DNA; note = nMG18-1 (D12A) protospacer and PAM for in vitro nickase assay
agccaccacgtcgcaagcctcgaccgtaattg

SEQ ID NO: 88 - DNA, 121 bp, synthetic construct
  source 1..121: mol_type = other DNA; note = nMG1-4 (D9A) single guide RNA for in vitro nickase assay
ccaccacgtcgcaagcctcgacgttttgatttactcgaaagagtccaatcataattgaccggagaataattgattcctctacaatgtacgaataaattcattctctaaaccttaaaaattt

SEQ ID NO: 89 - DNA, 99 bp, synthetic construct
  source 1..99: mol_type = other DNA; note = nMG1-6 (D13A) single guide RNA for in vitro nickase assay
ccaccacgtcgcaagcctcgacgttttgacttgaaaaagtcttaactgattttgccgaatttcaagctctgcattgcaccttggcattcggcatatttt

SEQ ID NO: 90 - DNA, 110 bp, synthetic construct
  source 1..110: mol_type = other DNA; note = nMG3-6 (D13A) single guide RNA for in vitro nickase assay
ccaccacgtcgcaagcctcgacgttgagaatcgaaagattcttaataaggcatccttccgatgctgacttctcaccgtccgttttccaataggagcgggcggtatgtttt

SEQ ID NO: 91 - DNA, 113 bp, synthetic construct
  source 1..113: mol_type = other DNA; note = nMG3-7 (D12A) single guide RNA for in vitro nickase assay
ccaccacgtcgcaagcctcgacgttgggaaccgaaaggttcccaataaggcgcatcttggcgctgacttctcaccgtcctcttgctgcttagcagagggcggtatgttttttt

SEQ ID NO: 92 - DNA, 118 bp, synthetic construct
  source 1..118: mol_type = other DNA; note = nMG3-8 (D13A) single guide RNA for in vitro nickase assay
ccaccacgtcgcaagcctcgacgttgagaatctttcgaaagaaagattcttaataaggcatccttccgatgctgacttctcaccgtccggctcctcttaggaacgggcggtatgtttt

SEQ ID NO: 93 - DNA, 124 bp, synthetic construct
  source 1..124: mol_type = other DNA; note = nMG4-5 (D17A) single guide RNA for in vitro nickase assay
ccaccacgtcgcaagcctcgacgctgtggcttgcgggggaaaccccttgtcacagtaagggactttcgttcgcgaaaggcaacctcgccagcatcgctgggcgaggaccagggcaaggcgattt

SEQ ID NO: 94 - DNA, 118 bp, synthetic construct
  source 1..118: mol_type = other DNA; note = nMG14-1 (D23A) single guide RNA for in vitro nickase assay
ccaccacgtcgcaagcctcgacgtcttgagcgaaagctccagacaaggggagccacttaagtggcttacccgtaaagtaacccccgttcaatcttcggattgggcggggcgaactttt

SEQ ID NO: 95 - DNA, 118 bp, synthetic construct
  source 1..118: mol_type = other DNA; note = nMG15-1 (D8A) single guide RNA for in vitro nickase assay
ccaccacgtcgcaagcctcgacgttgtaattccctagaaataggttattacaataaggtccaacaggagtgttggtaccgtaaagctctaacggcacccacgggtgccgttatctttt

SEQ ID NO: 96 - DNA, 101 bp, synthetic construct
  source 1..101: mol_type = other DNA; note = nMG18-1 (D12A) single guide RNA for in vitro nickase assay
ccaccacgtcgcaagcctcgacgtttgagagtagtgaaaactacgagttcaaatacaattttttcaaattgccctatagggccctcacagtgtgagatttt

SEQ ID NO: 97 - DNA, 22 bp, synthetic construct
  source 1..22: mol_type = other DNA; note = MGA1-4 sgRNA spacer 1 (targeting E. coli lacZ)
cgtttgccgtctgaatttgacc

SEQ ID NO: 98 - DNA, 22 bp, synthetic construct
  source 1..22: mol_type = other DNA; note = MGA1-4 sgRNA spacer 2 (targeting E. coli lacZ)
gaagatcaggatatgtggcgga

SEQ ID NO: 99 - DNA, 22 bp, synthetic construct
  source 1..22: mol_type = other DNA; note = MGA1-4 sgRNA spacer 3 (targeting E. coli lacZ)
acgggtaacagtttctttatgg

SEQ ID NO: 100 - DNA, 22 bp, synthetic construct
  source 1..22: mol_type = other DNA; note = MGA1-6 sgRNA spacer 1 (targeting E. coli lacZ)
cgttgctgcataaaccgactac

SEQ ID NO: 101 - DNA, 22 bp, synthetic construct
  source 1..22: mol_type = other DNA; note = MGA1-6 sgRNA spacer 2 (targeting E. coli lacZ)
aaaacccgaaactgtggagcgc

SEQ ID NO: 102 - DNA, 22 bp, synthetic construct
  source 1..22: mol_type = other DNA; note = MGA1-6 sgRNA spacer 3 (targeting E. coli lacZ)
gattgaaaatggtctgctgctg

SEQ ID NO: 103 - DNA, 22 bp, synthetic construct
  source 1..22: mol_type = other DNA; note = MGA3-6 sgRNA spacer 1 (targeting E. coli lacZ)
tacgggtaacagtttctttatg

SEQ ID NO: 104 - DNA, 22 bp, synthetic construct
  source 1..22: mol_type = other DNA; note = MGA3-6 sgRNA spacer 2 (targeting E. coli lacZ)
gcgttggcaatttaaccgccag

SEQ ID NO: 105 - DNA, 22 bp, synthetic construct
  source 1..22: mol_type = other DNA; note = MGA3-6 sgRNA spacer 3 (targeting E. coli lacZ)
ctgaatatcgacggtttccata

SEQ ID NO: 106 - DNA, 22 bp, synthetic construct
  source 1..22: mol_type = other DNA; note = MGA3-7 sgRNA spacer 1 (targeting E. coli lacZ)
cacatttaatgttgatgaaagc

SEQ ID NO: 107 - DNA, 22 bp, synthetic construct
  source 1..22: mol_type = other DNA; note = MGA3-7 sgRNA spacer 2 (targeting E. coli lacZ)
acacaaatcagcgatttccatg

SEQ ID NO: 108 - DNA, 22 bp, synthetic construct
  source 1..22: mol_type = other DNA; note = MGA3-7 sgRNA spacer 3 (targeting E. coli lacZ)
atggatgagcagacgatggtgc

SEQ ID NO: 109 - DNA, 22 bp, synthetic construct
  source 1..22: mol_type = other DNA; note = MGA3-8 sgRNA spacer 1 (targeting E. coli lacZ)
ttcatctgtggtgcaacgggcg

SEQ ID NO: 110 - DNA, 22 bp, synthetic construct
  source 1..22: mol_type = other DNA; note = MGA3-8 sgRNA spacer 2 (targeting E. coli lacZ)
acgagcatcatcctctgcatgg

SEQ ID NO: 111 - DNA, 22 bp, synthetic construct
  source 1..22: mol_type = other DNA; note = MGA3-8 sgRNA spacer 3 (targeting E. coli lacZ)
cgacccgcattgaccctaacgc

SEQ ID NO: 112 - DNA, 22 bp, synthetic construct
  source 1..22: mol_type = other DNA; note = MGA4-5 sgRNA spacer 1 (targeting E. coli lacZ)
cacaaatcagcgatttccatgt

SEQ ID NO: 113 - DNA, 22 bp, synthetic construct
  source 1..22: mol_type = other DNA; note = MGA4-5 sgRNA spacer 2 (targeting E. coli lacZ)
tgatgaagcagaacaactttaa

SEQ ID NO: 114 - DNA, 22 bp, synthetic construct
  source 1..22: mol_type = other DNA; note = MGA4-5 sgRNA spacer 3 (targeting E. coli lacZ)
aatattgaaacccacggcatgg

SEQ ID NO: 115 - DNA, 22 bp, synthetic construct
  source 1..22: mol_type = other DNA; note = MGA14-1 sgRNA spacer 1 (targeting E. coli lacZ)
tcaaaaaatggctttcgctacc

SEQ ID NO: 116 - DNA, 22 bp, synthetic construct
  source 1..22: mol_type = other DNA; note = MGA14-1 sgRNA spacer 2 (targeting E. coli lacZ)
aagcagcgttgttgcagtgcac

SEQ ID NO: 117 - DNA, 22 bp, synthetic construct
  source 1..22: mol_type = other DNA; note = MGA14-1 sgRNA spacer 3 (targeting E. coli lacZ)
tcagccggaaaacctaccggat

SEQ ID NO: 118 - DNA, 22 bp, synthetic construct
  source 1..22: mol_type = other DNA; note = MGA15-1 sgRNA spacer 1 (targeting E. coli lacZ)
gaagatcaggatatgtggcgga

SEQ ID NO: 119 - DNA, 22 bp, synthetic construct
  source 1..22: mol_type = other DNA; note = MGA15-1 sgRNA spacer 2 (targeting E. coli lacZ)
aacgtcgaaaacccgaaactgt

SEQ ID NO: 120 - DNA, 22 bp, synthetic construct
  source 1..22: mol_type = other DNA; note = MGA15-1 sgRNA spacer 3 (targeting E. coli lacZ)
aaacccacggcatggtgccaat

SEQ ID NO: 121 - DNA, 22 bp, synthetic construct
  source 1..22: mol_type = other DNA; note = MGA18-1 sgRNA spacer 1 (targeting E. coli lacZ)
aaaacccgaaactgtggagcgc

SEQ ID NO: 122 - DNA, 22 bp, synthetic construct
  source 1..22: mol_type = other DNA; note = MGA18-1 sgRNA spacer 2 (targeting E. coli lacZ)
ggcaactctggctcacagtacg

SEQ ID NO: 123 - DNA, 22 bp, synthetic construct
  source 1..22: mol_type = other DNA; note = MGA18-1 sgRNA spacer 3 (targeting E. coli lacZ)
ccggaaaacctaccggattgat

SEQ ID NO: 124 - DNA, 20 bp, synthetic construct
  source 1..20: mol_type = other DNA; note = ABE8.17m sgRNA spacer 1 (targeting E. coli lacZ)
tttctttcacagatgtggat

SEQ ID NO: 125 - DNA, 20 bp, synthetic construct
  source 1..20: mol_type = other DNA; note = ABE8.17m sgRNA spacer 2 (targeting E. coli lacZ)
caggatatgtggcggatgag

SEQ ID NO: 126 - DNA, 20 bp, synthetic construct
  source 1..20: mol_type = other DNA; note = ABE8.17m sgRNA spacer 3 (targeting E. coli lacZ)
tgcgaatacgcccacgcgat

SEQ ID NO: 127 - DNA, 22 bp, synthetic construct
  source 1..22: mol_type = other DNA; note = MGC1-4 sgRNA spacer 1 (targeting E. coli lacZ)
cggcgtttcatctgtggtgcaa

SEQ ID NO: 128 - DNA, 22 bp, synthetic construct
  source 1..22: mol_type = other DNA; note = MGC1-4 sgRNA spacer 2 (targeting E. coli lacZ)
gccaggacagtcgtttgccgtc

SEQ ID NO: 129 - DNA, 22 bp, synthetic construct
  source 1..22: mol_type = other DNA; note = MGC1-4 sgRNA spacer 3 (targeting E. coli lacZ)
tcagccgcgctgtactggaggc

SEQ ID NO: 130 - DNA, 22 bp, synthetic construct
  source 1..22: mol_type = other DNA; note = MGC1-6 sgRNA spacer 1 (targeting E. coli lacZ)
cccttcccaacagttgcgcagc

SEQ ID NO: 131 - DNA, 22 bp, synthetic construct
  source 1..22: mol_type = other DNA; note = MGC1-6 sgRNA spacer 2 (targeting E. coli lacZ)
ctgtcgtcgtcccctcaaactg

SEQ ID NO: 132 - DNA, 22 bp, synthetic construct
  source 1..22: mol_type = other DNA; note = MGC1-6 sgRNA spacer 3 (targeting E. coli lacZ)
ctacgtctgaacgtcgaaaacc

SEQ ID NO: 133 - DNA, 22 bp, synthetic construct
  source 1..22: mol_type = other DNA; note = MGC3-6 sgRNA spacer 1 (targeting E. coli lacZ)
gtgacggcagttatctggaaga

SEQ ID NO: 134 - DNA, 22 bp, synthetic construct
  source 1..22: mol_type = other DNA; note = MGC3-6 sgRNA spacer 2 (targeting E. coli lacZ)
atgatttcagccgcgctgtact

SEQ ID NO: 135 - DNA, 22 bp, synthetic construct
  source 1..22: mol_type = other DNA; note = MGC3-6 sgRNA spacer 3 (targeting E. coli lacZ)
ttactgccgcctgttttgaccg

SEQ ID NO: 136 - DNA, 22 bp, synthetic construct
  source 1..22: mol_type = other DNA; note = MGC3-7 sgRNA spacer 1 (targeting E. coli lacZ)
cgaatggcgctttgcctggttt

SEQ ID NO: 137 - DNA, 22 bp, synthetic construct
  source 1..22: mol_type = other DNA; note = MGC3-7 sgRNA spacer 2 (targeting E. coli lacZ)
tcccctcaaactggcagatgca

SEQ ID NO: 138 - DNA, 22 bp, synthetic construct
  source 1..22: mol_type = other DNA; note = MGC3-7 sgRNA spacer 3 (targeting E. coli lacZ)
atctacaccaacgtgacctatc

SEQ ID NO: 139 - DNA, 22 bp, synthetic construct
  source 1..22: mol_type = other DNA; note = MGC3-8 sgRNA spacer 1 (targeting E. coli lacZ)
ttcatctgtggtgcaacgggcg

SEQ ID NO: 140 - DNA, 22 bp, synthetic construct
  source 1..22: mol_type = other DNA; note = MGC3-8 sgRNA spacer 2 (targeting E. coli lacZ)
acgagcatcatcctctgcatgg

SEQ ID NO: 141 - DNA, 22 bp, synthetic construct
  source 1..22: mol_type = other DNA; note = MGC3-8 sgRNA spacer 3 (targeting E. coli lacZ)
cgacccgcattgaccctaacgc

SEQ ID NO: 142 - DNA, 22 bp, synthetic construct
  source 1..22: mol_type = other DNA; note = MGC4-5 sgRNA spacer 1 (targeting E. coli lacZ)
caacgggcgctgggtcggttac

SEQ ID NO: 143 - DNA, 22 bp, synthetic construct
  source 1..22: mol_type = other DNA; note = MGC4-5 sgRNA spacer 2 (targeting E. coli lacZ)
cacaaatcagcgatttccatgt

SEQ ID NO: 144 - DNA, 22 bp, synthetic construct
  source 1..22: mol_type = other DNA; note = MGC4-5 sgRNA spacer 3 (targeting E. coli lacZ)
aaggcggcggagccgacaccac

SEQ ID NO: 145 - DNA, 22 bp, synthetic construct
  source 1..22: mol_type = other DNA; note = MGC14-1 sgRNA spacer 1 (targeting E. coli lacZ)
cggtcaatccgccgtttgttcc

SEQ ID NO: 146 - DNA, 22 bp, synthetic construct
  source 1..22: mol_type = other DNA; note = MGC14-1 sgRNA spacer 2 (targeting E. coli lacZ)
tcctttgcgaatacgcccacgc

SEQ ID NO: 147 - DNA, 22 bp, synthetic construct
  source 1..22: mol_type = other DNA; note = MGC14-1 sgRNA spacer 3 (targeting E. coli lacZ)
ggtcggcttacggcggtgattt

SEQ ID NO: 148 - DNA, 22 bp, synthetic construct
  source 1..22: mol_type = other DNA; note = MGC15-1 sgRNA spacer 1 (targeting E. coli lacZ)
gccgatcgcgtcacactacgtc

SEQ ID NO: 149 - DNA, 22 bp, synthetic construct
  source 1..22: mol_type = other DNA; note = MGC15-1 sgRNA spacer 2 (targeting E. coli lacZ)
gatccgcgctggctaccggcga

SEQ ID NO: 150 - DNA, 22 bp, synthetic construct
  source 1..22: mol_type = other DNA; note = MGC15-1 sgRNA spacer 3 (targeting E. coli lacZ)
ccttcccgcccggtgcagtatg

SEQ ID NO: 151 - DNA, 22 bp, synthetic construct
  source 1..22: mol_type = other DNA; note = MGC18-1 sgRNA spacer 1 (targeting E. coli lacZ)
tcagccgcgctgtactggaggc

SEQ ID NO: 152 - DNA, 22 bp, synthetic construct
  source 1..22: mol_type = other DNA; note = MGC18-1 sgRNA spacer 2 (targeting E. coli lacZ)
gaccagcccttcccggctgtgc

SEQ ID NO: 153 - DNA, 22 bp, synthetic construct
  source 1..22: mol_type = other DNA; note = MGC18-1 sgRNA spacer 3 (targeting E. coli lacZ)
tccgtttatccgggcaaaccat

SEQ ID NO: 154 - DNA, 20 bp, synthetic construct
  source 1..20: mol_type = other DNA; note = BE3 sgRNA spacer 1 (targeting E. coli lacZ)
cctctggatgtcgctccaca

SEQ ID NO: 155 - DNA, 20 bp, synthetic construct
  source 1..20: mol_type = other DNA; note = BE3 sgRNA spacer 2 (targeting E. coli lacZ)
gggacgcgcgaattgaatta

SEQ ID NO: 156 - DNA, 20 bp, synthetic construct
  source 1..20: mol_type = other DNA; note = BE3 sgRNA spacer 3 (targeting E. coli lacZ)
cgttttacaacgtcgtgact

SEQ ID NO: 157 - DNA, 40 bp, synthetic construct
  source 1..40: mol_type = other DNA; note = Site-directed mutagenesis of MG1-4 (D9A)
tgaaaaagaaagttttcgcatttgcgcttggtaaagcaag

SEQ ID NO: 158 - DNA, 27 bp, synthetic construct
  source 1..27: mol_type = other DNA; note = Site-directed mutagenesis of MG1-4 (D9A)
tggtatatctccttcttaaagttaaac

SEQ ID NO: 159 - DNA, 35 bp, synthetic construct
  source 1..35: mol_type = other DNA; note = Site-directed mutagenesis of MG1-6 (D13A)
accatgtttggggctttgcgattggcaaagggtct

SEQ ID NO: 160 - DNA, 25 bp, synthetic construct
  source 1..25: mol_type = other DNA; note = Site-directed mutagenesis of MG1-6 (D13A)
tgttcttttctttctccatggtata

SEQ ID NO: 161 - DNA, 35 bp, synthetic construct
  source 1..35: mol_type = other DNA; note = Site-directed mutagenesis of MG3-6 (D13A)
attatcgcattggcgtggcggtcggggatcgcagc

SEQ ID NO: 162 - DNA, 21 bp, synthetic construct
  source 1..21: mol_type = other DNA; note = Site-directed mutagenesis of MG3-6 (D13A)
tcttcatatcggttgacatgg

SEQ ID NO: 163 - DNA, 35 bp, synthetic construct
  source 1..35: mol_type = other DNA; note = Site-directed mutagenesis of MG3-7 (D12A)
agtaccgcattggcatcgcggtgggcgatcgctcg

SEQ ID NO: 164 - DNA, 22 bp, synthetic construct
  source 1..22: mol_type = other DNA; note = Site-directed mutagenesis of MG3-7 (D12A)
tagtatgttcgctcatggtata

SEQ ID NO: 165 - DNA, 35 bp, synthetic construct
  source 1..35: mol_type = other DNA; note = Site-directed mutagenesis of MG3-8 (D13A)
attaccgcattggcgtggcggtaggtgatcgtagt

SEQ ID NO: 166 - DNA, 21 bp, synthetic construct
  source 1..21: mol_type = other DNA; note = Site-directed mutagenesis of MG3-8 (D13A)
tcttcatatcagtgctcatgg

SEQ ID NO: 167 - DNA, 35 bp, synthetic construct
  source 1..35: mol_type = other DNA; note = Site-directed mutagenesis of MG4-5 (D17A)
gctactgcttgggcctggcggtaggtgtgcaagga

SEQ ID NO: 168 - DNA, 18 bp, synthetic construct
  source 1..18: mol_type = other DNA; note = Site-directed mutagenesis of MG4-5 (D17A)
tggtcgcctgcagggtct

SEQ ID NO: 169 - DNA, 35 bp, synthetic construct
  source 1..35: mol_type = other DNA; note = Site-directed mutagenesis of MG14-1 (D23A)
acctggttctgggtatggcgccgggcatcgcctca

SEQ ID NO: 170 - DNA, 18 bp, synthetic construct
  source 1..18: mol_type = other DNA; note = Site-directed mutagenesis of MG14-1 (D23A)
ggcgaggcaagcctaatt

SEQ ID NO: 171 - DNA, 35 bp, synthetic construct
  source 1..35: mol_type = other DNA; note = Site-directed mutagenesis of MG15-1 (D8A)
actatgtgctcggcctggcggtcggtattgcttca

SEQ ID NO: 172 - DNA, 25 bp, synthetic construct
  source 1..25: mol_type = other DNA; note = Site-directed mutagenesis of MG15-1 (D8A)
tcatggtatatctccttcttaaagt

SEQ ID NO: 173 - DNA, 40 bp, synthetic construct
  source 1..40: mol_type = other DNA; note = Site-directed mutagenesis of MG18-1 (D12A)
taaagagtactacattggtctggcgggtggtacggactcg

SEQ ID NO: 174 - DNA, 21 bp, synthetic construct
  source 1..21: mol_type = other DNA; note = Site-directed mutagenesis of MG18-1 (D12A)
ctctggtccatggtatatctc

SEQ ID NO: 175 - DNA, 42 bp, synthetic construct
  source 1..42: mol_type = other DNA; note = Site-directed mutagenesis of SpCas9 (D10A)
gataagaaatactcaataggactggcgattggcacaaatagc

SEQ ID NO: 176 - DNA, 25 bp, synthetic construct
  source 1..25: mol_type = other DNA; note = Site-directed mutagenesis of SpCas9 (D10A)
catggtatatctccttcttaaagtt

SEQ ID NO: 177 - DNA, 21 bp, synthetic construct
  source 1..21: mol_type = other DNA; note = For lacZ sequencing
ccaggctttacactttatgct

SEQ ID NO: 178 - DNA, 19 bp, synthetic construct
  source 1..19: mol_type = other DNA; note = For lacZ sequencing
gtatgtggtggatgaagcc

SEQ ID NO: 179 - DNA, 18 bp, synthetic construct
  source 1..18: mol_type = other DNA; note = Amplify the fragment for nickase assay
agcttccagggggaaacg

SEQ ID NO: 180 - DNA, 26 bp, synthetic construct
  source 1..26: mol_type = other DNA; note = Amplify the fragment for nickase assay
attaacctataaaaataggcgtatca

SEQ ID NO: 181 - DNA, 60 bp, synthetic construct
  source 1..60: mol_type = other DNA; note = Amplify T7 promoter-His tag-adenine deaminase for MGA entry plasmid
gatataccatgggcagcagtcatcatcatcaccatcactccgaggttgaatttagtcatg

SEQ ID NO: 182 - DNA, 60 bp, synthetic construct
  source 1..60: mol_type = other DNA; note = Amplify T7 promoter-His tag-adenine deaminase for MGA entry plasmid
agactttcctcttcttcttgggagacccgccagagcctcgaggacccaccagagctgcct

SEQ ID NO: 183 - DNA, 55 bp, synthetic construct
  source 1..55: mol_type = other DNA; note = Amplify SV40 NLS-vector backbone for MGA entry plasmid
tctggcgggtctcccaagaagaagaggaaagtctaagatccggctgctaacaaag

SEQ ID NO: 184 - DNA, 45 bp, synthetic construct
  source 1..45: mol_type = other DNA; note = Amplify SV40 NLS-vector backbone for MGA entry plasmid
ctccttgcatgctctagaattaattaaaccattccttgcggcggc

SEQ ID NO: 185 - DNA, 48 bp, synthetic construct
  source 1..48: mol_type = other DNA; note = Amplify vector backbone for MGA entry plasmid
aggaatggtttaattaattctagagcatgcaaggagatggcgcccaac

SEQ ID NO: 186 - DNA, 56 bp, synthetic construct
  source 1..56: mol_type = other DNA; note = Amplify vector backbone for MGA entry plasmid
gtgatggtgatgatgatgactgctgcccatggtatatctccttcttaaagttaaac

SEQ ID NO: 187 - DNA, 60 bp, synthetic construct
  source 1..60: mol_type = other DNA; note = Amplify T7 promoter-His-tag-cytosine deaminase for MGC entry plasmid
aggagatataccatgggcagcagtcatcatcatcaccatcacatgtcgtctgagaccggg

SEQ ID NO: 188 - DNA, 60 bp, synthetic construct
  source 1..60: mol_type = other DNA; note = Amplify T7 promoter-His-tag-cytosine deaminase for MGC entry plasmid
taatatctgaaagattggtagaaccaccagacccgcggcagattcaggtgtcgcactttc

SEQ ID NO: 189 - DNA, 44 bp, synthetic construct
  source 1..44: mol_type = other DNA; note = Amplify UGI-SV40 NLS for MGC entry plasmid
cgacacctgaatctgccgcgggtctggtggttctaccaatcttt

SEQ ID NO: 190 - DNA, 60 bp, synthetic construct
  source 1..60: mol_type = other DNA; note = Amplify UGI-SV40 NLS for MGC entry plasmid
ttagactttcctcttcttcttgggagaaccaccagaaagcattttgatcttgttttcgcc

SEQ ID NO: 191 - DNA, 54 bp, synthetic construct
  source 1..54: mol_type = other DNA; note = Amplify SV40 NLS-vector backbone for MGC entry plasmid
ctggtggttctcccaagaagaagaggaaagtctaagatccggctgctaacaaag

SEQ ID NO: 192 - DNA, 45 bp, synthetic construct
  source 1..45: mol_type = other DNA; note = Amplify SV40 NLS-vector backbone for MGC entry plasmid
ctccttgcatgctctagaattaattaaccattccttgcggcggcg

SEQ ID NO: 193 - DNA, 48 bp, synthetic construct
  source 1..48: mol_type = other DNA; note = Amplify vector backbone for MGC entry plasmid
aggaatggttaattaattctagagcatgcaaggagatggcgcccaaca

SEQ ID NO: 194 - DNA, 50 bp, synthetic construct
  source 1..50: mol_type = other DNA; note = Amplify vector backbone for MGC entry plasmid
gtgatgatgatgactgctgcccatggtatatctccttcttaaagttaaac

SEQ ID NO: 195 - DNA, 55 bp, synthetic construct
  source 1..55: mol_type = other DNA; note = Amplify nMG1-4 (D9A) for pMGA expression plasmid
aaagtagtggaggcagctctggtgggtccatgaaaaagaaagttttcgcatttgc

SEQ ID NO: 196 - DNA, 55 bp, synthetic construct
  source 1..55: mol_type = other DNA; note = Amplify nMG1-4 (D9A) for pMGA expression plasmid
ctcttcttcttgggagacccgccagagcctttgctttcgacttttttaaattcgg

SEQ ID NO: 197 - DNA, 54 bp, synthetic construct
  source 1..54: mol_type = other DNA; note = Amplify nMG1-6 (D13A) for pMGA expression plasmid
gaaagtagtggaggcagctctggtgggtccatggagaaagaaaagaacaaccat

SEQ ID NO: 198 - DNA, 50 bp, synthetic construct
  source 1..50: mol_type = other DNA; note = Amplify nMG1-6 (D13A) for pMGA expression plasmid
cctcttcttcttgggagacccgccagagcccagttcacttaactcgacgc

SEQ ID NO: 199 - DNA, 55 bp, synthetic construct
  source 1..55: mol_type = other DNA; note = Amplify nMG3-6 (D13A) for pMGA expression plasmid
gaaagtagtggaggcagctctggtgggtccatgtcaaccgatatgaagaattatc

SEQ ID NO: 200 - DNA, 48 bp, synthetic construct
  source 1..48: mol_type = other DNA; note = Amplify nMG3-6 (D13A) for pMGA expression plasmid
cctcttcttcttgggagacccgccagagcccccctctactccaagcgc

SEQ ID NO: 201 - DNA, 52 bp, synthetic construct
  source 1..52: mol_type = other DNA; note = Amplify nMG3-7 (D12A) for pMGA expression plasmid
gaaagtagtggaggcagctctggtgggtccatgagcgaacatactaagtacc

SEQ ID NO: 202 - DNA, 50 bp, synthetic construct
  source 1..50: mol_type = other DNA; note = Amplify nMG3-7 (D12A) for pMGA expression plasmid
cctcttcttcttgggagacccgccagagccttcttgttcatcaagggctg

SEQ ID NO: 203 - DNA, 54 bp, synthetic construct
  source 1..54: mol_type = other DNA; note = Amplify nMG3-8 (D13A) for pMGA expression plasmid
gaaagtagtggaggcagctctggtgggtccatgagcactgatatgaagaattac

SEQ ID NO: 204 - DNA, 48 bp, synthetic construct
  source 1..48: mol_type = other DNA; note = Amplify nMG3-8 (D13A) for pMGA expression plasmid
cctcttcttcttgggagacccgccagagccaccctcgacgcctaacgc

SEQ ID NO: 205 - DNA, 48 bp, synthetic construct
  source 1..48: mol_type = other DNA; note = Amplify nMG4-5 (D17A) for pMGA expression plasmid
gaaagtagtggaggcagctctggtgggtccatgggagatcagcagacc

SEQ ID NO: 206 - DNA, 48 bp, synthetic construct
  source 1..48: mol_type = other DNA; note = Amplify nMG4-5 (D17A) for pMGA expression plasmid
cctcttcttcttgggagacccgccagagccatcgttcgcgggaaacac

SEQ ID NO: 207 - DNA, 55 bp, synthetic construct
  source 1..55: mol_type = other DNA; note = Amplify nMG14-1 (D23A) for pMGA expression plasmid
gaaagtagtggaggcagctctggtgggtccatggaaattacaattaaccgtgaga

SEQ ID NO: 208 - DNA, 48 bp, synthetic construct
  source 1..48: mol_type = other DNA; note = Amplify nMG14-1 (D23A) for pMGA expression plasmid
cctcttcttcttgggagacccgccagagcccttaatcgggctctcacg

SEQ ID NO: 209 - DNA, 49 bp, synthetic construct
  source 1..49: mol_type = other DNA; note = Amplify nMG15-1 (D8A) for pMGA expression plasmid
gaaagtagtggaggcagctctggtgggtccatgaactatgtgctcggcc

SEQ ID NO: 210 - DNA, 48 bp, synthetic construct
  source 1..48: mol_type = other DNA; note = Amplify nMG15-1 (D8A) for pMGA expression plasmid
cctcttcttcttgggagacccgccagagccacggaacgtttggcgctt

SEQ ID NO: 211 - DNA, 52 bp, synthetic construct
  source 1..52: mol_type = other DNA; note = Amplify nMG18-1 (D12A) for pMGA expression plasmid
gaaagtagtggaggcagctctggtgggtccatggaccagagtaaagagtact

SEQ ID NO: 212 - DNA, 54 bp, synthetic construct
  source 1..54: mol_type = other DNA; note = Amplify nMG18-1 (D12A) for pMGA expression plasmid
cctcttcttcttgggagacccgccagagcccagatcatttaaacacacctcttg

SEQ ID NO: 213 - DNA, 55 bp, synthetic construct
  source 1..55: mol_type = other DNA; note = Amplify SpCas9 (D10A) for pMGA expression plasmid
gaaagtagtggaggcagctctggtgggtccatggataagaaatactcaataggac

SEQ ID NO: 214 - DNA, 48 bp, synthetic construct
  source 1..48: mol_type = other DNA; note = Amplify SpCas9 (D10A) for pMGA expression plasmid
cctcttcttcttgggagacccgccagagccgtcacctcccagctgact

SEQ ID NO: 215 - DNA, 56 bp, synthetic construct
  source 1..56: mol_type = other DNA; note = Amplify nMG1-4 (D9A) for pMGC expression plasmid
acatccgaaagtgcgacacctgaatctgccatgaaaaagaaagttttcgcatttgc

SEQ ID NO: 216 - DNA, 56 bp, synthetic construct
  source 1..56: mol_type = other DNA; note = Amplify nMG1-4 (D9A) for pMGC expression plasmid
atctgaaagattggtagaaccaccagaccctttgctttcgacttttttaaattcgg

SEQ ID NO: 217 - DNA, 54 bp, synthetic construct
  source 1..54: mol_type = other DNA; note = Amplify nMG1-6 (D13A) for pMGC expression plasmid
acatccgaaagtgcgacacctgaatctgccatggagaaagaaaagaacaaccat

SEQ ID NO: 218 - DNA, 50 bp, synthetic construct
  source 1..50: mol_type = other DNA; note = Amplify nMG1-6 (D13A) for pMGC expression plasmid
atctgaaagattggtagaaccaccagaccccagttcacttaactcgacgc

SEQ ID NO: 219 - DNA, 54 bp, synthetic construct
  source 1..54: mol_type = other DNA; note = Amplify nMG3-6 (D13A) for pMGC expression plasmid
catccgaaagtgcgacacctgaatctgccatgtcaaccgatatgaagaattatc

SEQ ID NO: 220 - DNA, 48 bp, synthetic construct
  source 1..48: mol_type = other DNA; note = Amplify nMG3-6 (D13A) for pMGC expression plasmid
atctgaaagattggtagaaccaccagaccccccctctactccaagcgc

SEQ ID NO: 221 - DNA, 52 bp, synthetic construct
  source 1..52: mol_type = other DNA; note = Amplify nMG3-7 (D12A) for pMGC expression plasmid
acatccgaaagtgcgacacctgaatctgccatgagcgaacatactaagtacc

SEQ ID NO: 222 - DNA, 50 bp, synthetic construct
  source 1..50: mol_type = other DNA; note = Amplify nMG3-7 (D12A) for pMGC expression plasmid
atctgaaagattggtagaaccaccagacccttcttgttcatcaagggctg

SEQ ID NO: 223 - DNA, 54 bp, synthetic construct
  source 1..54: mol_type = other DNA; note = Amplify nMG3-8 (D13A) for pMGC expression plasmid
acatccgaaagtgcgacacctgaatctgccatgagcactgatatgaagaattac

SEQ ID NO: 224 - DNA, 48 bp, synthetic construct
  source 1..48: mol_type = other DNA; note = Amplify nMG3-8 (D13A) for pMGC expression plasmid
atctgaaagattggtagaaccaccagacccaccctcgacgcctaacgc

SEQ ID NO: 225 - DNA, 48 bp, synthetic construct
  source 1..48: mol_type = other DNA; note = Amplify nMG4-5 (D17A) for pMGC expression plasmid
acatccgaaagtgcgacacctgaatctgccatgggagatcagcagacc

SEQ ID NO: 226 - DNA, 48 bp, synthetic construct
  source 1..48: mol_type = other DNA; note = Amplify nMG4-5 (D17A) for pMGC expression plasmid
atctgaaagattggtagaaccaccagacccatcgttcgcgggaaacac

SEQ ID NO: 227 - DNA, 54 bp, synthetic construct
  source 1..54: mol_type = other DNA; note = Amplify nMG14-1 (D23A) for pMGC expression plasmid
acatccgaaagtgcgacacctgaatctgccatggaaattacaattaaccgtgag

SEQ ID NO: 228 - DNA, 49 bp, synthetic construct
  source 1..49: mol_type = other DNA; note = Amplify nMG14-1 (D23A) for pMGC expression plasmid
atctgaaagattggtagaaccaccagaccccttaatcgggctctcacga

SEQ ID NO: 229 - DNA, 49 bp, synthetic construct
  source 1..49: mol_type = other DNA; note = Amplify nMG15-1 (D8A) for pMGC expression plasmid
acatccgaaagtgcgacacctgaatctgccatgaactatgtgctcggcc

SEQ ID NO: 230 - DNA, 48 bp, synthetic construct
  source 1..48: mol_type = other DNA; note = Amplify nMG15-1 (D8A) for pMGC expression plasmid
atctgaaagattggtagaaccaccagacccacggaacgtttggcgctt

SEQ ID NO: 231 - DNA, 49 bp, synthetic construct
  source 1..49: mol_type = other DNA; note = Amplify nMG18-1 (D12A) for pMGC expression plasmid
atccgaaagtgcgacacctgaatctgccatggaccagagtaaagagtac

SEQ ID NO: 232 - DNA, 55 bp, synthetic construct
  source 1..55: mol_type = other DNA; note = Amplify nMG18-1 (D12A) for pMGC expression plasmid
tatctgaaagattggtagaaccaccagaccccagatcatttaaacacacctcttg

SEQ ID NO: 233 - DNA, 55 bp, synthetic construct
  source 1..55: mol_type = other DNA; note = Amplify SpCas9 (D10A) for pMGC expression plasmid
acatccgaaagtgcgacacctgaatctgccatggataagaaatactcaataggac

SEQ ID NO: 234 - DNA, 48 bp, synthetic construct
  source 1..48: mol_type = other DNA; note = Amplify SpCas9 (D10A) for pMGC expression plasmid
atctgaaagattggtagaaccaccagacccgtcacctcccagctgact

SEQ ID NO: 235 - DNA, 44 bp, synthetic construct
  source 1..44: mol_type = other DNA; note = Amplify MGA1-4_sgRNA spacer 1
ggtcaaattcagacggcaaacgctatagtgagtcgtattaaggt

SEQ ID NO: 236 - DNA, 50 bp, synthetic construct
  source 1..50: mol_type = other DNA; note = Amplify MGA1-4_sgRNA spacer 1
tatagcgtttgccgtctgaatttgaccgttttgatttactcgaaagagtc

SEQ ID NO: 237 - DNA, 50 bp, synthetic construct
  source 1..50: mol_type = other DNA; note = Amplify MGA1-4_sgRNA spacer 2
caaaactccgccacatatcctgatcttcctatagtgagtcgtattaaggt

SEQ ID NO: 238 - DNA, 50 bp, synthetic construct
  source 1..50: mol_type = other DNA; note = Amplify MGA1-4_sgRNA spacer 2
tataggaagatcaggatatgtggcggagttttgatttactcgaaagagtc

SEQ ID NO: 239 - DNA, 50 bp, synthetic construct
  source 1..50: mol_type = other DNA; note = Amplify MGA1-4_sgRNA spacer 3
caaaacccataaagaaactgttacccgtctatagtgagtcgtattaaggt

SEQ ID NO: 240 - DNA, 50 bp, synthetic construct
  source 1..50: mol_type = other DNA; note = Amplify MGA1-4_sgRNA spacer 3
tatagacgggtaacagtttctttatgggttttgatttactcgaaagagtc

SEQ ID NO: 241 - DNA, 50 bp, synthetic construct
  source 1..50: mol_type = other DNA; note = Amplify MGA1-6_sgRNA spacer 1
caaaacgtagtcggtttatgcagcaacgctatagtgagtcgtattaaggt

SEQ ID NO: 242 - DNA, 50 bp, synthetic construct
  source 1..50: mol_type = other DNA; note = Amplify MGA1-6_sgRNA spacer 1
tagcgttgctgcataaaccgactacgttttgacttgaaaaagtcttaact

SEQ ID NO: 243 - DNA, 50 bp, synthetic construct
  source 1..50: mol_type = other DNA; note = Amplify MGA1-6_sgRNA spacer 2
caaaacgcgctccacagtttcgggttttctatagtgagtcgtattaaggt

SEQ ID NO: 244 - DNA, 50 bp, synthetic construct
  source 1..50: mol_type = other DNA; note = Amplify MGA1-6_sgRNA spacer 2
tagaaaacccgaaactgtggagcgcgttttgacttgaaaaagtcttaact

SEQ ID NO: 245 - DNA, 50 bp, synthetic construct
  source 1..50: mol_type = other DNA; note = Amplify MGA1-6_sgRNA spacer 3
caaaaccagcagcagaccattttcaatcctatagtgagtcgtattaaggt

SEQ ID NO: 246 - DNA, 50 bp, synthetic construct
  source 1..50: mol_type = other DNA; note = Amplify MGA1-6_sgRNA spacer 3
taggattgaaaatggtctgctgctggttttgacttgaaaaagtcttaact

SEQ ID NO: 247 - DNA, 50 bp, synthetic construct
  source 1..50: mol_type = other DNA; note = Amplify MGA3-6_sgRNA spacer 1
ctcaaccataaagaaactgttacccgtactatagtgagtcgtattaaggt

SEQ ID NO: 248 - DNA, 50 bp, synthetic construct
  source 1..50: mol_type = other DNA; note = Amplify MGA3-6_sgRNA spacer 1
atagtacgggtaacagtttctttatggttgagaatcgaaagattcttaat

SEQ ID NO: 249 - DNA, 50 bp, synthetic construct
  source 1..50: mol_type = other DNA; note = Amplify MGA3-6_sgRNA spacer 2
ctcaacctggcggttaaattgccaacgcctatagtgagtcgtattaaggt

SEQ ID NO: 250 - DNA, 50 bp, synthetic construct
  source 1..50: mol_type = other DNA; note = Amplify MGA3-6_sgRNA spacer 2
taggcgttggcaatttaaccgccaggttgagaatcgaaagattcttaata

SEQ ID NO: 251 - DNA, 50 bp, synthetic construct
  source 1..50: mol_type = other DNA; note = Amplify MGA3-6_sgRNA spacer 3
ctcaactatggaaaccgtcgatattcagctatagtgagtcgtattaaggt

SEQ ID NO: 252 - DNA, 50 bp, synthetic construct
  source 1..50: mol_type = other DNA; note = Amplify MGA3-6_sgRNA spacer 3
tagctgaatatcgacggtttccatagttgagaatcgaaagattcttaata

SEQ ID NO: 253 - DNA, 50 bp, synthetic construct
  source 1..50: mol_type = other DNA; note = Amplify MGA3-7_sgRNA spacer 1
cccaacgctttcatcaacattaaatgtgctatagtgagtcgtattaaggt

SEQ ID NO: 254 - DNA, 50 bp, synthetic construct
  source 1..50: mol_type = other DNA; note = Amplify MGA3-7_sgRNA spacer 1
tcactatagcacatttaatgttgatgaaagcgttgggaaccgaaaggttc

SEQ ID NO: 255 - DNA, 50 bp, synthetic construct
  source 1..50: mol_type = other DNA; note = Amplify MGA3-7_sgRNA spacer 2
cccaaccatggaaatcgctgatttgtgtctatagtgagtcgtattaaggt

SEQ ID NO: 256 - DNA, 50 bp, synthetic construct
  source 1..50: mol_type = other DNA; note = Amplify MGA3-7_sgRNA spacer 2
tcactatagacacaaatcagcgatttccatggttgggaaccgaaaggttc

SEQ ID NO: 257 - DNA, 50 bp, synthetic construct
  source 1..50: mol_type = other DNA; note = Amplify MGA3-7_sgRNA spacer 3
cccaacgcaccatcgtctgctcatccatctatagtgagtcgtattaaggt

SEQ ID NO: 258 - DNA, 50 bp, synthetic construct
  source 1..50: mol_type = other DNA; note = Amplify MGA3-7_sgRNA spacer 3
tcactatagatggatgagcagacgatggtgcgttgggaaccgaaaggttc

SEQ ID NO: 259 - DNA, 50 bp, synthetic construct
  source 1..50: mol_type = other DNA; note = Amplify MGA4-5_sgRNA spacer 1
cacagcacatggaaatcgctgatttgtgctatagtgagtcgtattaaggt

SEQ ID NO: 260 - DNA, 48 bp, synthetic construct
  source 1..48: mol_type = other DNA; note = Amplify MGA4-5_sgRNA spacer 1
cactatagcacaaatcagcgatttccatgtgctgtggcttgcggggga

SEQ ID NO: 261 - DNA, 50 bp, synthetic construct
  source 1..50: mol_type = other DNA; note = Amplify MGA4-5_sgRNA spacer 2
cacagcttaaagttgttctgcttcatcactatagtgagtcgtattaaggt

SEQ ID NO: 262 - DNA, 48 bp, synthetic construct
  source 1..48: mol_type = other DNA; note = Amplify MGA4-5_sgRNA spacer 2
cactatagtgatgaagcagaacaactttaagctgtggcttgcggggga

SEQ ID NO: 263 - DNA, 50 bp, synthetic construct
  source 1..50: mol_type = other DNA; note = Amplify MGA4-5_sgRNA spacer 3
cacagcccatgccgtgggtttcaatattctatagtgagtcgtattaaggt

SEQ ID NO: 264 - DNA, 48 bp, synthetic construct
  source 1..48: mol_type = other DNA; note = Amplify MGA4-5_sgRNA spacer 3
cactatagaatattgaaacccacggcatgggctgtggcttgcggggga

SEQ ID NO: 265 - DNA, 50 bp, synthetic construct
  source 1..50: mol_type = other DNA; note = Amplify MGA14-1_sgRNA spacer 1
caagacggtagcgaaagccattttttgactatagtgagtcgtattaaggt

SEQ ID NO: 266 - DNA, 48 bp, synthetic construct
  source 1..48: mol_type = other DNA; note = Amplify MGA14-1_sgRNA spacer 1
cactatagtcaaaaaatggctttcgctaccgtcttgagcgaaagctcc

SEQ ID NO: 267 - DNA, 50 bp, synthetic construct
  source 1..50: mol_type = other DNA; note = Amplify MGA14-1_sgRNA spacer 2
caagacgtgcactgcaacaacgctgcttctatagtgagtcgtattaaggt

SEQ ID NO: 268 - DNA, 48 bp, synthetic construct
  source 1..48: mol_type = other DNA; note = Amplify MGA14-1_sgRNA spacer 2
cactatagaagcagcgttgttgcagtgcacgtcttgagcgaaagctcc

SEQ ID NO: 269 - DNA, 50 bp, synthetic construct
  source 1..50: mol_type = other DNA; note = Amplify MGA14-1_sgRNA spacer 3
caagacatccggtaggttttccggctgactatagtgagtcgtattaaggt

SEQ ID NO: 270 - DNA, 48 bp, synthetic construct
  source 1..48: mol_type = other DNA; note = Amplify MGA14-1_sgRNA spacer 3
cactatagtcagccggaaaacctaccggatgtcttgagcgaaagctcc

SEQ ID NO: 271 - DNA, 50 bp, synthetic construct
  source 1..50: mol_type = other DNA; note = Amplify MGA15-1_sgRNA spacer 1
tacaactccgccacatatcctgatcttcctatagtgagtcgtattaaggt

SEQ ID NO: 272 - DNA, 50 bp, synthetic construct
  source 1..50: mol_type = other DNA; note = Amplify MGA15-1_sgRNA spacer 1
tataggaagatcaggatatgtggcggagttgtaattccctagaaataggt

SEQ ID NO: 273 - DNA, 50 bp, synthetic construct
  source 1..50: mol_type = other DNA; note = Amplify MGA15-1_sgRNA spacer 2
tacaacacagtttcgggttttcgacgttctatagtgagtcgtattaaggt

SEQ ID NO: 274 - DNA, 50 bp, synthetic construct
  source 1..50: mol_type = other DNA; note = Amplify MGA15-1_sgRNA spacer 2
tatagaacgtcgaaaacccgaaactgtgttgtaattccctagaaataggt

SEQ ID NO: 275 - DNA, 50 bp, synthetic construct
  source 1..50: mol_type = other DNA; note = Amplify MGA15-1_sgRNA spacer 3
tacaacattggcaccatgccgtgggtttctatagtgagtcgtattaaggt

SEQ ID NO: 276 - DNA, 50 bp, synthetic construct
  source 1..50: mol_type = other DNA; note = Amplify MGA15-1_sgRNA spacer 3
tatagaaacccacggcatggtgccaatgttgtaattccctagaaataggt

SEQ ID NO: 277 - DNA, 50 bp, synthetic construct
  source 1..50: mol_type = other DNA; note = Amplify MGA18-1_sgRNA spacer 1
tcaaacgcgctccacagtttcgggttttctatagtgagtcgtattaaggt

SEQ ID NO: 278 - DNA, 50 bp, synthetic construct
  source 1..50: mol_type = other DNA; note = Amplify MGA18-1_sgRNA spacer 1
tatagaaaacccgaaactgtggagcgcgtttgagagtagtgaaaactacg

SEQ ID NO: 279 - DNA, 50 bp, synthetic construct
  source 1..50: mol_type = other DNA; note = Amplify MGA18-1_sgRNA spacer 2
tcaaaccgtactgtgagccagagttgccctatagtgagtcgtattaaggt

SEQ ID NO: 280 - DNA, 50 bp, synthetic construct
  source 1..50: mol_type = other DNA; note = Amplify MGA18-1_sgRNA spacer 2
tatagggcaactctggctcacagtacggtttgagagtagtgaaaactacg

SEQ ID NO: 281 - DNA, 50 bp, synthetic construct
  source 1..50: mol_type = other DNA; note = Amplify MGA18-1_sgRNA spacer 3
tcaaacatcaatccggtaggttttccggctatagtgagtcgtattaaggt

SEQ ID NO: 282 - DNA, 50 bp, synthetic construct
  source 1..50: mol_type = other DNA; note = Amplify MGA18-1_sgRNA spacer 3
tatagccggaaaacctaccggattgatgtttgagagtagtgaaaactacg

SEQ ID NO: 283 - DNA, 41 bp, synthetic construct
  source 1..41: mol_type = other DNA; note = Amplify ABE8.17m_sgRNA spacer 1
atccacatctgtgaaagaaactatagtgagtcgtattagga

SEQ ID NO: 284 - DNA, 45 bp, synthetic construct
  source 1..45: mol_type = other DNA; note = Amplify ABE8.17m_sgRNA spacer 1
tttctttcacagatgtggatgttttagagctagaaatagcaagtt

SEQ ID NO: 285 - DNA, 41 bp, synthetic construct
  source 1..41: mol_type = other DNA; note = Amplify ABE8.17m_sgRNA spacer 2
ctcatccgccacatatcctgctatagtgagtcgtattagga

SEQ ID NO: 286 - DNA, 45 bp, synthetic construct
  source 1..45: mol_type = other DNA; note = Amplify ABE8.17m_sgRNA spacer 2
caggatatgtggcggatgaggttttagagctagaaatagcaagtt

SEQ ID NO: 287 - DNA, 41 bp, synthetic construct
  source 1..41: mol_type = other DNA; note = Amplify ABE8.17m_sgRNA spacer 3
atcgcgtgggcgtattcgcactatagtgagtcgtattagga

SEQ ID NO: 288 - DNA, 45 bp, synthetic construct
  source 1..45: mol_type = other DNA; note = Amplify ABE8.17m_sgRNA spacer 3
tgcgaatacgcccacgcgatgttttagagctagaaatagcaagtt

SEQ ID NO: 289 - DNA, 50 bp, synthetic construct
  source 1..50: mol_type = other DNA; note = Amplify MGC1-4_spacer 1
caaaacttgcaccacagatgaaacgccgctatagtgagtcgtattaaggt

SEQ ID NO: 290 - DNA, 50 bp, synthetic construct
  source 1..50: mol_type = other DNA; note = Amplify MGC1-4_spacer 1
tatagcggcgtttcatctgtggtgcaagttttgatttactcgaaagagtc

SEQ ID NO: 291 - DNA, 50 bp, synthetic construct
  source 1..50: mol_type = other DNA; note = Amplify MGC1-4_spacer 2
caaaacgacggcaaacgactgtcctggcctatagtgagtcgtattaaggt

SEQ ID NO: 292 - DNA, 50 bp, synthetic construct
  source 1..50: mol_type = other DNA; note = Amplify MGC1-4_spacer 2
tataggccaggacagtcgtttgccgtcgttttgatttactcgaaagagtc

SEQ ID NO: 293 - DNA, 50 bp, synthetic construct
  source 1..50: mol_type = other DNA; note = Amplify MGC1-4_spacer 3
caaaacgcctccagtacagcgcggctgactatagtgagtcgtattaaggt

SEQ ID NO: 294 - DNA, 50 bp, synthetic construct
  source 1..50: mol_type = other DNA; note = Amplify MGC1-4_spacer 3
tatagtcagccgcgctgtactggaggcgttttgatttactcgaaagagtc

SEQ ID NO: 295 - DNA, 50 bp, synthetic construct
  source 1..50: mol_type = other DNA; note = Amplify MGC1-6_spacer 1
caaaacgctgcgcaactgttgggaagggctatagtgagtcgtattaaggt

SEQ ID NO: 296 - DNA, 50 bp, synthetic construct
  source 1..50: mol_type = other DNA; note = Amplify MGC1-6_spacer 1
tagcccttcccaacagttgcgcagcgttttgacttgaaaaagtcttaact

SEQ ID NO: 297 - DNA, 50 bp, synthetic construct
  source 1..50: mol_type = other DNA; note = Amplify MGC1-6_spacer 2
caaaaccagtttgaggggacgacgacagctatagtgagtcgtattaaggt

SEQ ID NO: 298 - DNA, 50 bp, synthetic construct
  source 1..50: mol_type = other DNA; note = Amplify MGC1-6_spacer 2
tagctgtcgtcgtcccctcaaactggttttgacttgaaaaagtcttaact

SEQ ID NO: 299 - DNA, 50 bp, synthetic construct
  source 1..50: mol_type = other DNA; note = Amplify MGC1-6_spacer 3
caaaacggttttcgacgttcagacgtagctatagtgagtcgtattaaggt

SEQ ID NO: 300 - DNA, 50 bp, synthetic construct
  source 1..50: mol_type = other DNA; note = Amplify MGC1-6_spacer 3
tagctacgtctgaacgtcgaaaaccgttttgacttgaaaaagtcttaact

SEQ ID NO: 301 - DNA, 50 bp, synthetic construct
  source 1..50: mol_type = other DNA; note = Amplify MGC3-6_spacer 1
ctcaactcttccagataactgccgtcacctatagtgagtcgtattaaggt

SEQ ID NO: 302 - DNA, 50 bp, synthetic construct
  source 1..50: mol_type = other DNA; note = Amplify MGC3-6_spacer 1
aggtgacggcagttatctggaagagttgagaatcgaaagattcttaataa

SEQ ID NO: 303 - DNA, 50 bp, synthetic construct
  source 1..50: mol_type = other DNA; note = Amplify MGC3-6_spacer 2
tcaacagtacagcgcggctgaaatcatctatagtgagtcgtattaaggtc

SEQ ID NO: 304 - DNA, 50 bp, synthetic construct
  source 1..50: mol_type = other DNA; note = Amplify MGC3-6_spacer 2
agatgatttcagccgcgctgtactgttgagaatcgaaagattcttaataa

SEQ ID NO: 305 - DNA, 50 bp, synthetic construct
  source 1..50: mol_type = other DNA; note = Amplify MGC3-6_spacer 3
ctcaaccggtcaaaacaggcggcagtaactatagtgagtcgtattaaggt

SEQ ID NO: 306 - DNA, 50 bp, synthetic construct
  source 1..50: mol_type = other DNA; note = Amplify MGC3-6_spacer 3
tagttactgccgcctgttttgaccggttgagaatcgaaagattcttaata

SEQ ID NO: 307 - DNA, 50 bp, synthetic construct
  source 1..50: mol_type = other DNA; note = Amplify MGC3-7_spacer 1
cccaacaaaccaggcaaagcgccattcgctatagtgagtcgtattaaggt

SEQ ID NO: 308 - DNA, 49 bp, synthetic construct
  source 1..49: mol_type = other DNA; note = Amplify MGC3-7_spacer 1
cactatagcgaatggcgctttgcctggtttgttgggaaccgaaaggttc

SEQ ID NO: 309 - DNA, 50 bp, synthetic construct
  source 1..50: mol_type = other DNA; note = Amplify MGC3-7_spacer 2
cccaactgcatctgccagtttgaggggactatagtgagtcgtattaaggt

SEQ ID NO: 310 - DNA, 49 bp, synthetic construct
  source 1..49: mol_type = other DNA; note = Amplify MGC3-7_spacer 2
cactatagtcccctcaaactggcagatgcagttgggaaccgaaaggttc

SEQ ID NO: 311 - DNA, 50 bp, synthetic construct
  source 1..50: mol_type = other DNA; note = Amplify MGC3-7_spacer 3
cccaacgataggtcacgttggtgtagatctatagtgagtcgtattaaggt

SEQ ID NO: 312 - DNA, 49 bp, synthetic construct
  source 1..49: mol_type = other DNA; note = Amplify MGC3-7_spacer 3
cactatagatctacaccaacgtgacctatcgttgggaaccgaaaggttc

SEQ ID NO: 313 - DNA, 50 bp, synthetic construct
  source 1..50: mol_type = other DNA; note = Amplify MGC4-5_spacer 1
cacagcgtaaccgacccagcgcccgttgctatagtgagtcgtattaaggt

SEQ ID NO: 314 - DNA, 48 bp, synthetic construct
  source 1..48: mol_type = other DNA; note = Amplify MGC4-5_spacer 1
cactatagcaacgggcgctgggtcggttacgctgtggcttgcggggga

SEQ ID NO: 315 - DNA, 50 bp, synthetic construct; identical to SEQ ID NO: 259
  source 1..50: mol_type = other DNA; note = Amplify MGC4-5_spacer 2

SEQ ID NO: 316 - DNA, 48 bp, synthetic construct; identical to SEQ ID NO: 260
  source 1..48: mol_type = other DNA; note = Amplify MGC4-5_spacer 2

SEQ ID NO: 317 - DNA, 50 bp, synthetic construct
  source 1..50: mol_type = other DNA; note = Amplify MGC4-5_spacer 3
cacagcgtggtgtcggctccgccgccttctatagtgagtcgtattaaggt

SEQ ID NO: 318 - DNA, 48 bp, synthetic construct
  source 1..48: mol_type = other DNA; note = Amplify MGC4-5_spacer 3
cactatagaaggcggcggagccgacaccacgctgtggcttgcggggga

SEQ ID NO: 319 - DNA, 50 bp, synthetic construct
  source 1..50: mol_type = other DNA; note = Amplify MGC14-1_spacer 1
caagacggaacaaacggcggattgaccgctatagtgagtcgtattaaggt

SEQ ID NO: 320 - DNA, 48 bp, synthetic construct
  source 1..48: mol_type = other DNA; note = Amplify MGC14-1_spacer 1
cactatagcggtcaatccgccgtttgttccgtcttgagcgaaagctcc

SEQ ID NO: 321 - DNA, 50 bp, synthetic construct
  source 1..50: mol_type = other DNA; note = Amplify MGC14-1_spacer 2
caagacgcgtgggcgtattcgcaaaggactatagtgagtcgtattaaggt

SEQ ID NO: 322 - DNA, 48 bp, synthetic construct
  source 1..48: mol_type = other DNA; note = Amplify MGC14-1_spacer 2
cactatagtcctttgcgaatacgcccacgcgtcttgagcgaaagctcc

SEQ ID NO: 323 - DNA, 50 bp, synthetic construct
  source 1..50: mol_type = other DNA; note = Amplify MGC14-1_spacer 3
caagacaaatcaccgccgtaagccgaccctatagtgagtcgtattaaggt

SEQ ID NO: 324 - DNA, 48 bp, synthetic construct
  source 1..48: mol_type = other DNA; note = Amplify MGC14-1_spacer 3
cactatagggtcggcttacggcggtgatttgtcttgagcgaaagctcc

SEQ ID NO: 325 - DNA, 50 bp, synthetic construct
  source 1..50: mol_type = other DNA; note = Amplify MGC15-1_spacer 1
tacaacgacgtagtgtgacgcgatcggcctatagtgagtcgtattaaggt

SEQ ID NO: 326 - DNA, 50 bp, synthetic construct
  source 1..50: mol_type = other DNA; note = Amplify MGC15-1_spacer 1
ataggccgatcgcgtcacactacgtcgttgtaattccctagaaataggtt

SEQ ID NO: 327 - DNA, 50 bp, synthetic construct
  source 1..50: mol_type = other DNA; note = Amplify MGC15-1_spacer 2
tacaactcgccggtagccagcgcggatcctatagtgagtcgtattaaggt

SEQ ID NO: 328 - DNA, 50 bp, synthetic construct
  source 1..50: mol_type = other DNA; note = Amplify MGC15-1_spacer 2
ataggatccgcgctggctaccggcgagttgtaattccctagaaataggtt

SEQ ID NO: 329 - DNA, 50 bp, synthetic construct
  source 1..50: mol_type = other DNA; note = Amplify MGC15-1_spacer 3
tacaaccatactgcaccgggcgggaaggctatagtgagtcgtattaaggt

SEQ ID NO: 330 - DNA, 50 bp, synthetic construct
  source 1..50: mol_type = other DNA; note = Amplify MGC15-1_spacer 3
atagccttcccgcccggtgcagtatggttgtaattccctagaaataggtt

SEQ ID NO: 331 - DNA, 50 bp, synthetic construct
  source 1..50: mol_type = other DNA; note = Amplify MGC18-1_spacer 1
tcaaacgcctccagtacagcgcggctgactatagtgagtcgtattaaggt

SEQ ID NO: 332 - DNA, 50 bp, synthetic construct
  source 1..50: mol_type = other DNA; note = Amplify MGC18-1_spacer 1
ctatagtcagccgcgctgtactggaggcgtttgagagtagtgaaaactac

SEQ ID NO: 333 - DNA, 50 bp, synthetic construct
  source 1..50: mol_type = other DNA; note = Amplify MGC18-1_spacer 2
tcaaacgcacagccgggaagggctggtcctatagtgagtcgtattaaggt

SEQ ID NO: 334 - DNA, 50 bp, synthetic construct
  source 1..50: mol_type = other DNA; note = Amplify MGC18-1_spacer 2
ctataggaccagcccttcccggctgtgcgtttgagagtagtgaaaactac

SEQ ID NO: 335 - DNA, 50 bp, synthetic construct
  source 1..50: mol_type = other DNA; note = Amplify MGC18-1_spacer 3
tcaaacatggtttgcccggataaacggactatagtgagtcgtattaaggt

SEQ ID NO: 336 - DNA, 50 bp, synthetic construct
  source 1..50: mol_type = other DNA; note = Amplify MGC18-1_spacer 3
ctatagtccgtttatccgggcaaaccatgtttgagagtagtgaaaactac

SEQ ID NO: 337 - DNA, 41 bp, synthetic construct
  source 1..41: mol_type = other DNA; note = Amplify BE3_sgRNA spacer 1
tgtggagcgacatccagaggctatagtgagtcgtattagga

SEQ ID NO: 338 - DNA, 45 bp, synthetic construct
  source 1..45: mol_type = other DNA; note = Amplify BE3_sgRNA spacer 1
cctctggatgtcgctccacagttttagagctagaaatagcaagtt

SEQ ID NO: 339 - DNA, 41 bp, synthetic construct
  source 1..41: mol_type = other DNA; note = Amplify BE3_sgRNA spacer 2
taattcaattcgcgcgtcccctatagtgagtcgtattagga

SEQ ID NO: 340 - DNA, 45 bp, synthetic construct
  source 1..45: mol_type = other DNA; note = Amplify BE3_sgRNA spacer 2
gggacgcgcgaattgaattagttttagagctagaaatagcaagtt

SEQ ID NO: 341 - DNA, 41 bp, synthetic construct
  source 1..41: mol_type = other DNA; note = Amplify BE3_sgRNA spacer 3
agtcacgacgttgtaaaacgctatagtgagtcgtattagga

SEQ ID NO: 342 - DNA, 45 bp, synthetic construct
  source 1..45: mol_type = other DNA; note = Amplify BE3_sgRNA spacer 3
cgttttacaacgtcgtgactgttttagagctagaaatagcaagtt

SEQ ID NO: 343 - DNA, 25 bp, synthetic construct
  source 1..25: mol_type = other DNA; note = For lacZ sequencing
cgaacatccaaaagtttgtgttttt

SEQ ID NO: 344 - DNA, 19 bp, synthetic construct
  source 1..19: mol_type = other DNA; note = For lacZ sequencing
tgagcgcatttttacgcgc

SEQ ID NO: 345 - DNA, 18 bp, synthetic construct
  source 1..18: mol_type = other DNA; note = For lacZ sequencing
gaaaacggcaacccgtgg

SEQ ID NO: 346 - DNA, 50 bp, synthetic construct
  source 1..50: mol_type = other DNA; note = Amplify sgRNA expression cassette
ccgccgccgcaaggaatggtttaattaattacggccagtcatgcataatc

SEQ ID NO: 347 - DNA, 50 bp, synthetic construct
  source 1..50: mol_type = other DNA; note = Amplify sgRNA expression cassette
gactgttgggcgccatctccttgcatgctcactgagcctccacctagcct

SEQ ID NO: 348 - DNA, 50 bp, synthetic construct
  source 1..50: mol_type = other DNA; note = Amplify MGA3-8_sgRNA spacer 1
ctcaaccgcccgttgcaccacagatgaactatagtgagtcgtattaaggt

SEQ ID NO: 349 - DNA, 50 bp, synthetic construct
  source 1..50: mol_type = other DNA; note = Amplify MGA3-8_sgRNA spacer 1
tatagttcatctgtggtgcaacgggcggttgagaatctttcgaaagaaag

SEQ ID NO: 350 - DNA, 50 bp, synthetic construct
  source 1..50: mol_type = other DNA; note = Amplify MGA3-8_sgRNA spacer 2
ctcaacccatgcagaggatgatgctcgtctatagtgagtcgtattaaggt

SEQ ID NO: 351 - DNA, 50 bp, synthetic construct
  source 1..50: mol_type = other DNA; note = Amplify MGA3-8_sgRNA spacer 2
atagacgagcatcatcctctgcatgggttgagaatctttcgaaagaaaga

SEQ ID NO: 352 - DNA, 50 bp, synthetic construct
  source 1..50: mol_type = other DNA; note = Amplify MGA3-8_sgRNA spacer 3
ctcaacgcgttagggtcaatgcgggtcgctatagtgagtcgtattaaggt

SEQ ID NO: 353 - DNA, 50 bp, synthetic construct
  source 1..50: mol_type = other DNA; note = Amplify MGA3-8_sgRNA spacer 3
tatagcgacccgcattgaccctaacgcgttgagaatctttcgaaagaaag

SEQ ID NO: 354 - DNA, 50 bp, synthetic construct; identical to SEQ ID NO: 348
  source 1..50: mol_type = other DNA; note = Amplify MGC3-8_sgRNA spacer 1

SEQ ID NO: 355 - DNA, 50 bp, synthetic construct; identical to SEQ ID NO: 349
  source 1..50: mol_type = other DNA; note = Amplify MGC3-8_sgRNA spacer 1

SEQ ID NO: 356 - DNA, 50 bp, synthetic construct; identical to SEQ ID NO: 350
  source 1..50: mol_type = other DNA; note = Amplify MGC3-8_sgRNA spacer 2

SEQ ID NO: 357 - DNA, 50 bp, synthetic construct; identical to SEQ ID NO: 351
  source 1..50: mol_type = other DNA; note = Amplify MGC3-8_sgRNA spacer 2

SEQ ID NO: 358 - DNA, 50 bp, synthetic construct; identical to SEQ ID NO: 352
  source 1..50: mol_type = other DNA; note = Amplify MGC3-8_sgRNA spacer 3

SEQ ID NO: 359 - DNA, 50 bp, synthetic construct; identical to SEQ ID NO: 353
  source 1..50: mol_type = other DNA; note = Amplify MGC3-8_sgRNA spacer 3

SEQ ID NO: 360-368 - skipped (9 entries)

SEQ ID NO: 369 - protein, 7 aa, synthetic construct
  source 1..7: note = SV40
PKKKRKV

SEQ ID NO: 370 - protein, 16 aa, unidentified
  source 1..16: note = nucleoplasmin bipartite NLS
KRPAATKKAGQAKKKK

SEQ ID NO: 371 - protein, 9 aa, unidentified
  source 1..9: note = c-myc NLS
PAAKRVKLD

SEQ ID NO: 372 - protein, 11 aa, unidentified
  source 1..11: note = c-myc NLS
RQRRNELKRSP

SEQ ID NO: 373 - protein, 38 aa, Homo sapiens
  source 1..38: note = hRNPA1 M9 NLS
NQSSNFGPMKGGNFGGRSSGPYGGGGQYFAKPRNQGGY

SEQ ID NO: 374 - protein, 42 aa, unidentified
  source 1..42: note = Importin-alpha IBB domain
RMRIZFKNKGKDTAELRRRRVEVSVELRKAKKDEQILKRRNV

SEQ ID NO: 375 - protein, 8 aa, unidentified
  source 1..8: note = Myoma T protein
VSRKRPRP

SEQ ID NO: 376 - protein, 8 aa, unidentified
  source 1..8: note = Myoma T protein
PPKKARED

SEQ ID NO: 377 - protein, 8 aa, unidentified
  source 1..8: note = p53
PQPKKKPL

SEQ ID NO: 378 - protein, 12 aa, Mus sp.
  source 1..12: note = mouse c-abl IV
SALIKKKKKMAP

SEQ ID NO: 379 - protein, 5 aa, Influenza virus
  source 1..5: note = influenza virus NS1
DRLRR

SEQ ID NO: 380 - protein, 7 aa, Influenza virus
  source 1..7: note = influenza virus NS1
PKQKKRK

SEQ ID NO: 381 - protein, 10 aa, Hepatitis delta virus
  source 1..10: note = Hepatitis virus delta antigen
RKLKKKIKKL

SEQ ID NO: 382 - protein, 10 aa, Mus sp.
  source 1..10: note = mouse Mx1 protein
REKKKFLKRR

SEQ ID NO: 383 - protein, 20 aa, Homo sapiens
  source 1..20: note = human poly(ADP-ribose) polymerase
KRKGDEVDGVDEVAKKKSKK

SEQ ID NO: 384 - protein, 17 aa, Homo sapiens
  source 1..17: note = steroid hormone receptor (human) glucocorticoid
RKCLQAGMNLEARKTKK

SEQ ID NO: 385 - protein, 170 aa, unidentified
  source 1..170: note = MG68-3 deaminase
MNEQTSTDEQFMQQALALADEAERQGEVPVGALLVHQGTVIGRGFNQVITQLDPSAHAEMLAIRDAARYLQNYRILDTTLYVTLEPCPMCAGALVHARVKRLVYGASDPRTGACGSVFNVVADTRLNHQLEVVAGVLGSQCGERLSAFFRQRRAAQKALKKAAQNFQSPS

SEQ ID NO: 386 - protein, 167 aa, unidentified
  source 1..167: note = MG68-4 deaminase
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAEDPKTGACGSVMDIARHPALNHQLQVDGGVMAAPCARLLSDFFRWRRAQKKAARDNSSGN

SEQ ID NO: 387 - protein, 173 aa, unidentified
  source 1..173: note = MG68-5 deaminase
MSTDFTSAAQQELDIAYMRKAIALAAQAEADGEVPVGAVLVHNNEIIGVGRNRVIGGCDPSLHAEFEAIRQGAQEIGNYRLLETTLYVTLEPCPMCAGLLVHSRIGRLVYGTPDLKTGAAGSLMNLLQHPELNHQIAITSGVLQADCAAQLSGFFSAQRERKKALKKRLKPNL

SEQ ID NO: 388 - protein, 182 aa, unidentified
  source 1..182: note = MG68-6 deaminase
MSEIPQVVTEQQTDERWMHYALALADKAEQAGEIPVGAVLVKDNQVIGEGWNMSICRHDPSAHAEMLAIREAAVRVQNYRLLDTTLYVTLEPCAMCAGLLVHSRVKRLVFGAFDAKTGAAGSVTDLVRHPVLNHQLEVTSGVLAEQCADKLSSFFRRRRQEHKAAKALRQAQDPENQGNSES

SEQ ID NO: 389 - protein, 151 aa, unidentified
  source 1..151: note = MG68-7 deaminase
MSDEIWIKHALTLADKAYQQGEVPVGAVLVKNNQIIAEGWNQPIAHHDPSAHAEIMALRLAGQAEQNYRLPETTLYVTLEPCVMCAGAMIHARIGRLVFGAYDPKTGAAGSVFDIFSDARHNHQIEVVSGVLSELCGDKLRAFFRERRKKR

SEQ ID NO: 390 - protein, 166 aa, unidentified
  source 1..166: note = MG68-8 deaminase
MPQSEQDIYWIRYAMQLAERAEQAGEVPVGAVLVLDNQALGEGWNLSISRHDPCAHAEIMAIRQAGERIGNYRLLGATLYVTLEPCVMCAGAMVHSRIARVVYGASDLKTGAAGSVFDVLSDPRHNHVVEITGGVESEACSQQLSDFFRRRRAEQKAEKQRLKDNQ

SEQ ID NO: 391 - protein, 168 aa, unidentified
  source 1..168: note = MG68-9 deaminase
MNVAADEQWMKEALRQAERALLAGEVPVGAVVVSQNNIVGQGFNRNLLDRDPTAHAEIIALREAAANIGNHRLLDCELYATIEPCAMCAGAITHARVRRLVYGAEDLKAGAVHSVMQVVNHPALNHRVEVKGGVLAERCGELLQQFFWARRAEQSGISGANEDQLRRG

SEQ ID NO: 392 - protein, 143 aa, unidentified
  source 1..143: note = MG68-10 deaminase
MLLAMEQARAAEEAGEVPVGAVILSPEGEVVARGENRVLRDSDPTAHAEMVALRAAGRVLGNYRLPGCTLYSTLEPCSMCSGAILHARVARLVFAASDPKAGACGSVLEVMNHPRLNHQVELVGGVLALECGQMLTEFFRARR

SEQ ID NO: 393 - protein, 210 aa, unidentified
  source 1..210: note = MG68-11 deaminase
MSAEIDLTDKAFMRQALDQAQNAWLLGEVPVGAVIVREGRVIATGYNRPIGDNDPTAHAEIVALRQAASLLGNYRLPGCTLYVTLEPCAMCAMALMHARLDRVVFGAPDPKTGAAGSVINLFDEPRLNHHCALRGGVEAQDCARLLQDFFRERRRQIQALQQKPAIPADRADPDEQHASLHAEGPAPLAGIDVRHLDEPDAAATSNPESP

SEQ ID NO: 394 - protein, 159 aa, unidentified
  source 1..159: note = MG68-12 deaminase
MEIKARMRDIMTDDERWMAKALRLAKEGAQAGEVPVGAILVFSGEQLAAAYNSPIRLRDATAHAEILALRLGGERLQNYRLTGCTLYVTLEPCAMCAGALVQARIARLVFGARDSRVGAAGSALDLAREPRFNHQVTVVGGVLASECEQVLREFFRARR

SEQ ID NO: 395 - protein, 205 aa, unidentified
  source 1..205: note = MG68-13 deaminase
MPEPFQGGDPADPARAAAEAQDLADRAFMRLALDQAHNAWLLGEVPVGAVIVHEGRVLATGYNRPIGDSDPTAHAEIVALRQAASLLGNYRLPGCTLYVTLEPCAMCAMALLHARIERVVFGASDPKTGAAGSVLDLFAQPLLNHHASLRAGVEAQACGALLQEFFRERRARARAQQQLPAHGGGIDVRHLDAPEPGDESDPFDE

SEQ ID NO: 396 - protein, 159 aa, unidentified
  source 1..159: note = MG68-14 deaminase
MGSDQDFMRLALLEAEKAGAIGEVPVGAVIVKDGKVVARGHNQPVSGHDPTAHAEIMALREAGQVLGNYRLPACDLYVTLEPCAMCIGAMIHARIRRVIFGAHDPKTGAAGSVINLFEEKTLNHHATVTGGILASDCAQLLKAFFAMRRKEAKTPSLSG

SEQ ID NO: 397 - protein, 168 aa, unidentified
  source 1..168: note = MG68-15 deaminase
MEPMEEHRHFMGLAIEEAARAYELNEVPVGAVLVGSAGEILSRASNAPIRSADPSAHAEMIALRQAARASGNYRLPGSVLYVTLEPCVMCVGAMLHARIATLVFGARDPRTGAAGSVVDLTSVPAFNHYVRVIAGVRAEECSELLRRFFRERRREGKSGYGGEVPKRP

SEQ ID NO: 398 - protein, 153 aa, unidentified
  source 1..153: note = MG68-16 deaminase
MADEDIKFMRLALELAKKAEFIDEVPVGALIIKDGEIIGTGMNSCISDHDPTSHAEIKAIRDAANTIKNYRLNGCSIYVTLEPCAMCVGAIQHARIEKIIYGANDPKTGACGSVIDLMSIKEINHHTEAIGGVLQKECGQILKDFFLSKRKKP

SEQ ID NO: 399 - protein, 148 aa, unidentified
  source 1..148: note = MG68-17 deaminase
MQRALGRAGDARAQGEVPVGAVVVCAGEVVGEGCNRNISLDDPSAHAEILALRAAGQRLGNYRLPGCTLYVTLEPCAMCVGAAIHSRLDGVVFGATDPKTGALGGAFDLPASHAHNHVLSVRGGLLADECGALLKAFFRDRRKAPRAP

SEQ ID NO: 400 - protein, 191 aa, unidentified
  source 1..191: note = MG68-18 deaminase
MQKKVDDFLKIVEPPDAERRTKGKLLQQRAVDEQWMGLALQRGEEAGRQGEVPVGAVVVGKDGFLTAAGNSPIGLADPSAHAEMLAIRAAAKLLGNYRLPEATLYVTLEPCIMCMGALIQARISRLVFGAADPKTGAAISVYAIGTDQRLNHTVAVTGGILAEACAQLLKNFFKKRRGHSPVINSPFLKTP

SEQ ID NO: 401 - protein, 144 aa, unidentified
  source 1..144: note = MG68-19 deaminase
MREAYALALIAYEQGEVPVGAVLVGEDDEILGRGWNQVIQRHDPMAHAECVAIQEAAAQLRNYRLNGSTLYVTLEPCCMCAGAMVHARIARLVFGARDVRSGAAGSAYNLLAGDLLNHRVKIDEGILQQECSHLLRNFFKQRRD

SEQ ID NO: 402 - protein, 195 aa, unidentified
  source 1..195: note = MG68-20 deaminase
MTSQVSRQQPLSGNNLVHNDLIASVCPPGLVPAQQDEFWMQQALVLARQAEMMGEVPVGAVVVKNQQLIGYGYNQSITLNDPSAHAEVLALRMAGQTLTNYRLPDTTLYVTLEPCAMCATTMVHARVARLVYGAADLKTGAAGSVLNLTNYTAFNHQLSCVSGVLQRDCSYLLSNFFKLRRTQHKAKKVSGTFIR

SEQ ID NO: 403 - protein, 162 aa, unidentified
  source 1..162: note = MG68-21 deaminase
MDHERYMRRAIELAQQAESLGEVPVGAVIVHDHQIIGEGFNEVIRRNDPSAHAEAQAIRAAGQHLANYRLVNTTLYVSLEPCAMCAGLIVHARVKTVVFATPDPRTGATGTAIQVLNHPSMNHHVEVVSGVLQEQSATILQNFFRKKRELAKMKKFHEKRVN

SEQ ID NO: 404 - protein, 166 aa, unidentified
  source 1..166: note = MG68-22 deaminase
MSDEHFMRLALAQAALAEAEGEIPVGAVVVLNGEVVGSGYNSPIGRHDPTAHAEIRALRAAAATLGNYRLVGCELFVTLEPCLMCAGAIQHARIARLVYGAADYKTGVCGSTLDVFGELPGSPVPRLNHHTQVTGGVLGDECSRQLSAFFARRRAEKNAAKNHVFQ

SEQ ID NO: 405 - protein, 161 aa, unidentified
  source 1..161: note = MG68-23 deaminase
MDSLVERHEHYMMLALRLAEKGADRGEVPVGAVVVSPKGQILSLAHNEPIDLHDPTGHAEIIAIRKAAQRIGNYRLVGCSLYVTLEPCVMCYGAIIHARIKRLFFGAYDPKAGAGTVFGLFSSPFFNHQPEVRGGILAELCEKVLKEFFEKLRSSKCCSSG

SEQ ID NO: 406 - protein, 152 aa, unidentified
  source 1..152: note = MG68-24 deaminase
MTEDERWMEEALALAREASNDGEAPVGAVVVHAGEIIGRGRNRIEGLADPTAHAELLALRQASMNLGRWRLTGCALFVTLEPCAMCLGACYAARVDRLVYGATSPKFGAAGSSVTLAGVERLNHRLEVVSGVLEKECARLLAKFFRGLRGKG

SEQ ID NO: 407 - protein, 168 aa, unidentified
  source 1..168: note = MG68-25 deaminase
MDDQHWMGRALALAERAAEQGEVPGGAVLVIENEIVGEGWSRPIATQDPSAHAEILALRDAGLRRGNYRLSGSVLYVTLEPCVMCAGAIVHARVDTLVFGAADPKAGACGSVFDLLPSDGRFNHHTQCRGPILADACGTILRAFFANKRASPRARANASAAHERPEND

SEQ ID NO: 408 - protein, 173 aa, unidentified
  source 1..173: note = MG68-26 deaminase
MSESQFDETQYRWMDRALELAGQAANLGEVPVGAVIVSAEGELLGEGFNQPIKVQDPTAHAEIMAIRQACRKTGNYRLPGAVLYVTLEPCAMCAGAIVHARLARVVFATCEPKAGAVESTLRFFDLPQLNHRVEYTGGLRRSEASSLLSHFFQSRREEKALLKKNSRQQQSDC

SEQ ID NO: 409 - protein, 164 aa, unidentified
  source 1..164: note = MG68-27 deaminase
MREEKDLIFMKKALHLAEEAWRQGEVPVGAVVVDGEGQIIGQGYNQSIALLDPTAHAEIVALRQAAKKKKNYRLSGSTLYVTLEPCPMCLGAMVQARIDRLVFGAYDPKNGAVSSIMNFPLDKMNHRFEIEGGLLSQECATILKEFFQSRRGETNNKKETAKEE

SEQ ID NO: 410 - protein, 153 aa, unidentified
  source 1..153: note = MG68-28 deaminase
MDTDEQFMQHAIQLAHKAQSQGEVPVGAILVKDNKIIGKGWNQPITRHDPSAHAEIMAIRHAGQALKNYRLPDTTLYVTLEPCNMCAGMIIHARIKRLVFAAYDPKTGAAGSVFDTLTDPRNNHTVEIEGGVLEEPCAEMLRHFFRQRRKKTP

SEQ ID NO: 411 - protein, 158 aa, unidentified
  source 1..158: note = MG68-29 deaminase
MSELENNNPQHIKWMREAIKLAQKAQECGEVPVGALITKNDTLISSAYNQPITKHDPTAHAEIQALQQAGKILQNYRLNDTVLYITLEPCAMCAGAIVHARIGTVVFGAYDHKTGVAGSAGNIFTAEFSNHKPKIIGGTLEKECSLIIRNFFQARRQK

SEQ ID NO: 412 - protein, 182 aa, unidentified
  source 1..182: note = MG68-30 deaminase
MPNFLKQLQQIIAFETSCAADWSEQQKHVFWMQQALKVAAYGEQLGEVPVGAVAVVENQLIAVGWNASISKHDPTAHAEVMALRAAGTVLKNYRQLQLTLYVTLEPCAMCAGAMVHARIAQLVYGASDPKTGAVDSVFNLLRHPNLNHQAPVLGGVLATECRTQLQDFFRRRRQEKKQAQQK

SEQ ID NO: 413 - protein, 167 aa, unidentified
  source 1..167: note = MG68-31 deaminase
MESVDEQWMRYAIRLAQRAEEQGEVPVGAVLVKGDRCLAEGWNVPVQRHDPTAHAEMVAIRDAGIALENYRLIDSTLYVTLEPCVMCMGAIAHARIKRLVFGAFDPKRGAVCNALSLTDASFLNHKVVWDGGVFEQECSELLIDFFKARRKVTKPEVVVTNPQRHGM

SEQ ID NO: 414 - protein, 160 aa, unidentified
  source 1..160: note = MG68-32 deaminase
MYNQQAIDKHFMNCALELATFAADSGEVPVGAVIVRKNTIVAKGSNSPIADHDPTAHAEIIAIRKATAQCANYRTPDTTLYVTLEPCIMCMGAIIQARIGRLVFGAYDAKTGAAGSCYSIGQDNLLNHSLEIAGGINEQQCAILLKKFFKIRRKKGSKNN

SEQ ID NO: 415 - protein, 150 aa, unidentified
  source 1..150: note = MG68-33 deaminase
MSDLEWMRRAITLAQKAEQQGEVPVGALLVREGVCVGEGWNQPILRHDPSAHAEINALRDAGQATENYRLIDTVLYVTLEPCVMCMGAIANARVRRLVFGASDPARGAAGSILSLSNASFLNHHIETEGGLLAEECSELLRSFFARRRRK

SEQ ID NO: 416 - protein, 155 aa, unidentified
  source 1..155: note = MG68-34 deaminase
MSPVVAESDRAWMRHALELANRAGEEGEVPVGAVMVKDGQLVGEGWNRVIGLNDPSAHAEILALREAGQRLGNYRLPGCSLYVTLEPCAMCAGAMLHARLERVYFGTGDPKTGALGGTFDLFADYPHNHRIETQGGLLEIECSSLLKEFFRARRL

SEQ ID NO: 417 - protein, 194 aa, unidentified
  source 1..194: note = MG68-35 deaminase
MGLNGLTHHSPFIPISENIDTSDKLALQIMSLKLSNPDEKWMRHAQSLAEHAAAQGEIPVGAVIVQAGECIAEGWNQPIANNDPTAHAEIIALRKAAQYLNNYRLVNTLLYVTLEPCVMCAGAIIQARVKRVIFGAYDPKAGAAGSRFDILRDTRHNYQVECISGVLAKECSDYLSRFFKNRRTRAKPSRFPKP

SEQ ID NO: 418 - protein, 174 aa, unidentified
  source 1..174: note = MG68-36 deaminase
MQDDTVPEEIDHERWMRQALNEAMDAAEEGEVPVGAVVVYENRIIGRGHNRTVATHDPSAHAEILALGAAGAAVGDWRLTGVDIYVSLEPCAMCAGAIQLGRLRRAVFGPRDPKFGGCGSVLDVLREPRLNHQVEVIEGVMAAESQHLLKEFFRRLRAKDRVPATPDPFPNAGE

SEQ ID NO: 419 - protein, 149 aa, unidentified
  source 1..149: note = MG68-37 deaminase
MEEEYFMREALKEAEKAAQEGEVPIGAVVVGPSREIIGRGYNRPIGLCDPTAHAEIMALREAAKRLGNYRLLDCEIYVTLEPCPMCAGALVYARLKRLVFGAHDPKAGACGSVYNIVQDKRLNHQLEVAGGLLAEECRALLQAFFKSRR

SEQ ID NO: 420 - protein, 160 aa, unidentified
  source 1..160: note = MG68-38 deaminase
MFEFSDNKAEFFMKQAILQAIRAWKKGEVPVGAVVVSGAGQILASAHNCPISLDDPTAHAEILALRLAAGKVGNYRLTDSWLISTLEPCVMCAGAMVWARVKGVVFGARDPVSGAFGSVMDINEVPGLNHRIEVTEGVLAAECSQLLKDFFKRRRQSSAG

SEQ ID NO: 421 - protein, 148 aa, unidentified
  source 1..148: note = MG68-39 deaminase
MTDENWMQRALQLAAQAEAVGEVPVGAVIVKNDTLVAEGFNQPIGAHDATAHAEIVALRRAGEALGNYRLVDTTLYVTLEPCSMCVGAMIHARVAKVVFGASDPRTGALGGAFDLQQAGRHNHRFDVVSGVMADSSRQLLQNFFRVRR

SEQ ID NO: 422 - protein, 149 aa, unidentified
  source 1..149: note = MG68-40 deaminase
MTEDEKWMNLAIEQAIKAQDEDEVPVGAVLVKNGLLLSQAHNQPISTNDATAHAEIQALRKAGIKLQNYRLTDSTLYVTLEPCAMCLGAMMHARIARIVYGANDLKTGACGSSENLLNANCFNHKIHLISGVLENECKQLLKKFFNSRR

SEQ ID NO: 423 - protein, 185 aa, unidentified
  source 1..185: note = MG68-41 deaminase
MNQVNCGRIGSRLIRTGGVNISRAPIEEDPVNDLQYAQDTKWMRCALDCARRAYSTEEVPIGAVLVRNEQIIGEGFNQTIRNLDPTSHAEIMAIRSAAENIGNYRLSDTTLYVTIEPCMMCLGAIIHARVERLVFGAQEPKAGVLKSHPVFDGDFLNHQVKWSSGILESECSRLMRDFFIHKRTL

SEQ ID NO: 424 - protein, 203 aa, unidentified
  source 1..203: note = MG68-42 deaminase
MAPVPLKQPLAGESFDAHDHAMMRLAIDQALNAQLHGEVPVGAVLVKGGQVIATGYNHPIGSHDPTAHAEIRTLRMAAEQLGNYRLGESTLYVTLEPCMMCLGAMLHARITRVVFGASDPKTGVCGGVLDLPAEGRLNHQTTVQGGLLAEECGELLQRFFAERRAQRRADREALRAQQDELLRWAATLPAEEEVGTLRLDEET

SEQ ID NO: 425 - protein, 150 aa, unidentified
  source 1..150: note = MG68-43 deaminase
MAMALAEAEKAMQIGEVPIGAVVVGPDQQLLGTGYNQSICLNDPSAHAEMLAIRAAAAQLGNYRLRDCTLYVTLEPCAMCMGAILHSRIQRVVFAAADPKTGACGSVLSLQSEPRLNHHCSVTQGVLAERAASLIKGFFKARRQVKKCRC

SEQ ID NO: 426 - protein, 164 aa, unidentified
  source 1..164: note = MG68-44 deaminase
MLHMVYYEINETNSQDVFFMRRALTLAQKAASADEVPVGAVAIANNEIIGEGFNCPIGTHDPTAHAEIMALRQAAQKSNNYRLPEVTLYVTLEPCVMCVGAMLHARIKRLVFGAIDQKTGAVVSVFKILDEKNLNHRIQYQSGVLAVPCGKILSDFFKDRRGVI

SEQ ID NO: 427 - protein, 180 aa, unidentified
  source 1..180: note = MG68-45 deaminase
MTALITTSNIHDKMMSLALKEAFKAYKLGEIPVGCVITDENNELVATGFNRTIIDNDPSAHAEIVALRKAGEKLQNYRLVNLNLYVTLEPCTMCSGAIIHARIKRVFFGAYDLKTGACGSVFNVLNDDRHNHKVEIYGGILKEECSSMLSDFFKARRKMQKEGRDWIVESGKDRTWLNKD

SEQ ID NO: 428 - protein, 153 aa, unidentified
  source 1..153: note = MG68-46 deaminase
MISDTEFMGAALELALAASKLGEVPVGAVVVKGGRIIGTGSNAPISRHDPTAHAEILALRAAASALENYRLTECTLYVTLEPCAMCAGAIQHARIARLVFGASDSKTGACGSVVNLFGEPMLNHHTQVQGGMLARDCGELLSDFFRQRRAAVQ

SEQ ID NO: 429 - protein, 160 aa, unidentified
  source 1..160: note = MG68-47 deaminase
MSGSDAAASRACMEQALACARDAEAAGEVPVGAVIVDAAGAVVARAANAPIARNDPTAHAELLVLRAAGRVLGNYRLPGCVLYVTLEPCAMCVGALVHARIARIVYGAPDPKTGACGSVFDLAANSKMNHRIEVAGGVLAEECGALLKQFFAARRGRDAP

SEQ ID NO: 430 - protein, 151 aa, unidentified
  source 1..151: note = MG68-48 deaminase
MFSRADQVFMRQALELAKQAKGEGEVPVGAVLTLNDLPIATAYNQSITHQDPTAHAEIIVLREAAKILKNYRLVNTVLYVTLEPCAMCAGALIHARVKRLIYATADPRTGACGSIFNLINHQALNHQIQYESGLLAEESKLLLQQFFQKRR

SEQ ID NO: 431 - protein, 148 aa, unidentified
  source 1..148: note = MG68-49 deaminase
MNDEHYIQYALNLAQKAESENEVPVGALIVCNNQIIAEGWNQPIQLHDSSAHAEMLALRKASHHIENYRLKNTTLYVTLEPCAMCVGAMIHARIQKLVFGAWDQKAGAVHSVFQLIDDTRHNHAIEWRGGVMADACSRVLKNFFKQRR

SEQ ID NO: 432 - protein, 153 aa, unidentified
  source 1..153: note = MG68-50 deaminase
MTSHDDTYWIIHALTLAKKAEQQGEVPVGAVIVHDHQIVGEGWNQPIGAGDPTAHAEIIAMRNAAQHLKNYRLINCTLYVTLEPCAMCVGAMVHARISRLVFGAFDPKAGAVTSVMQLLDAPHFNHIVTHQGGICAEKCSEILKSFFAMKRKT

SEQ ID NO: 433 - protein, 155 aa, unidentified
  source 1..155: note = MG68-51 deaminase
MTDDRDLYWMQQALLLAVDAGRRGEVPVGALLVLDEVSIGVGYNRPIGDRDPTAHAEIIALRDAAKKINNYRLLDTTLYVTLEPCMMCAAAMVHARIKRLVYGAPDPKAGAIVSQAQILDAPFFNHRVAYYGNLLAMPCGELLRTFFKAKRLSST

SEQ ID NO: 434 - protein, 153 aa, unidentified
  source 1..153: note = MG68-52 deaminase
MRLAMDMAKEAYSIGEVPVGCVIADADGNVISTGYNRSITDNDPSAHAEMVAIRNAGSLLKNYRMPGLSLYVTLEPCCMCSGAIIHARIARVYYGASDLKTGACGSVFNVMSDPRHNHSVECIGGILADECSKMLSDFFKERRQQKKAEATKL

SEQ ID NO: 435 - protein, 174 aa, unidentified
  source 1..174: note = MG68-53 deaminase
MTVNHEYFMRLAIEQALLAYQAGEIPVGAVIVDTDGNVIGRGFNRTILDNDPSAHAEIVALRDAGERVKNYRLINLDMYVTLEPCTMCSGALIHSRLNNLYFGAYDLKTGACGSRFNILGSSEYNHIVNVTGGILKEECQNIISDFFKARRKMQKDGRDWIVESGKVRSWQKNV

SEQ ID NO: 436 - protein, 172 aa, unidentified
  source 1..172: note = MG68-54 deaminase
MTSPTAGLGETDEYWMNRALALAAEAGESGEVPVGAVVVLDGREVGAGYNGPIGSCDPTAHAEIRALRDAGARAGNYRLPGATLYVTLEPCTMCVGAIVHARINRLVYGTTEPKAGAVESIRQTLRDDHFNWQVEATGGVLASQCREIIQRFFAGRREYHRLRKQTLSVKEQ

SEQ ID NO: 437 - protein, 158 aa, unidentified
  source 1..158: note = MG68-55 deaminase
MPDLDDGYWMQQALKLAAQAKDQGEVPVGALVVGEQKLLGQGYNQVISLQDPSAHAEVMALRGAGITQQNYRLVNTTLYVTLEPCMMCAGVLVHARIKRLVFGAYDPKAGAISSCAQLLTLPHLNHQILVQGGILAKECGQQLTDFFKAKRQAKHDKG

SEQ ID NO: 438 - protein, 157 aa, unidentified
  source 1..157: note = MG68-56 deaminase
MTAAAEFDEHDLRWMRQALELARRAERDHAEVPVGAVLVIDNEVIGSGMNRNIIDHDASAHAEIVCLRDAGQRVANHRFPGSTLYVTLEPCVMCAGAIVHARVGRVVYAASDPKTGAAGSVFDILTSERHNHRVAVRGGLLAEESARLLQLFFRSRR

SEQ ID NO: 439 - protein, 176 aa, unidentified
  source 1..176: note = MG68-57 deaminase
MSESSAVYSDEYWLRYALQLAERAYQQGEVPVGAVLVRDNQILGEGWNQSISQHDATAHAEIMALRAAGLVAGNYRLPNTSLYVTLEPCVMCAGALLHARVERVVFGAYDPKTGAVGSMFDVLLDARHNHQVQLTGGVLQADCVAQLQAFFKERRLAQKLAKFNSVTISSPTSTEN

SEQ ID NO: 440 - protein, 158 aa, unidentified
  source 1..158: note = MG68-58 deaminase
MSLADRHEMFMQMALQQAQLAYDCAEVPVGAVVVNSAGEVIGKGYNRTIIDSDPTAHAEIVALRQAAAHEQNYRLPDLTVYVTLEPCVMCIGALTHARIAHVVYGASDPKTGACGSVLCIQANKKINHHTRITSGVLEQACAEKLRHFFRERRKGSKL

SEQ ID NO: 441 - protein, 154 aa, unidentified
  source 1..154: note = MG68-59 deaminase
MADDDFMALAIEQALLAQAQGEVPVGAVLVDGSGHVIGRGANAVIGLSDPTAHAEIVALRSAAKLLGNYRLPQTTLFVTLEPCAMCLGALFHARVSRIVFGAPDPKTGACGSRLDLTAPDLINFHASVRGGVMQEACGHLLTDFFKRKRSEKLS

SEQ ID NO: 442 - protein, 204 aa, unidentified
  source 1..204: note = MG68-60 deaminase
MRVALGAAREAQAAGEVPVGAVIVRDGVLIATGRNAPRQQHDPTAHAEIAALRAAARRLGNYRLDGCTLYVTLEPCLMCVGAMLHARLERVVFGAPDPKTGAAGSVFNALAEPKLNHQTTVEGGVLATECAALLQVFFGQRRLLQRISAQPLRDDALRTSEARMAAFASPLSRWVCDLPALQGLRLHYLDMGPSTEGRAWLLLH

SEQ ID NO: 443 - protein, 168 aa, unidentified
  source 1..168: note = MG68-61 deaminase
MNTEQSKPLLGDAHFMQQALQLADAAFALQEVPVGAVVVQDGIIIGRGFNAPITQHDPCAHAEILALRDAAKNIGNYRLVGCELFVTLEPCVMCAGAMMHARIARVVYGAYDLKTGACGSVQNVFNEPRWNHHTICTGGVLAEQCGTKLSQFFALRRAQKKSLTATWT

SEQ ID NO: 444 - protein, 283 aa, unidentified
  source 1..283: note = MG121-1 deaminase
MKVTLGGQTIDVEEVLKRISSTTVAAALIKDGEVVAVEETGGEHAEKKLVRKHDVEGAVIFVTARPCRYCAEAMAEAGVAGVVYLGKGRGYGPYLLERLGVPCVEVHPSEPPAWRPVPRLDVLITFGGNPYLTEEDVAARTYALLTGIGVEAEVVPAPNNMAGRVEVMVKRGDPDRAHGRLKETFGPVFKVRRFQLSGDYEDRESLAEDVLEVVEPLIEDPFAVRANVASPGPTFSGSKEAEVFIGDVLTSAGHEVDLEDPRTLVHVDVLGRRVSVGVERRDG

SEQ ID NO: 445 - protein, 279 aa, unidentified
  source 1..279: note = MG121-2 deaminase
VKITLAGETIDVEKVLREIPTRTVTAALIKDGEVKAYEEADGEHAEKKLIRNHDVSDGVVFVTIRPCLYCARELAKAGVAGVVYIGRGRGLGPYYLARKGIEVVEVNPSRPLHYDPVERLDVLVTFGGNPYLTEEDVAARVYCLLTGKGIKAEIAPAPENLAGRVEVMITDGDSERAARVIERELPTFNVRHFLLSDRFDDREELSKRVLEEIEPRVEDPFAVRARIARAGLFSSSRDAEVFLGDVLTSAGHEVDLDEPRTVVHVDVLGDRVSVGVEKR

SEQ ID NO: 446 - protein, 283 aa, unidentified
  source 1..283: note = MG121-3 deaminase
MKVTLGGQTIDVEEVLKRISSTTVAAALIKDGEVVAVEETGGEHAEKKLVRKHDVEGAVIFVTARPCRYCAEAMAEAGVAGVVYLGKGRGYGPYLLERLGVPCVEVHPSEPPAWRPVPRLDVLITFGGNPYLTEEDVAARTYALLTGIGIEAEVVPAPNNMAGRVEVMVKRGDPDRAHGRLKETFGSVFKVRRFQLSGDYEDRESLAEDVLEVVEPLIEDPFAVRANVASPGPTFSGSKEAEVFIGDVLTSAGHEVDLEDPRTLVHVDVLGRRVSVGVERRDG

SEQ ID NO: 447 - protein, 280 aa, unidentified
  source 1..280: note = MG121-4 deaminase
MRSAEYLAYLRRRYGLRPNRRLGQHFMVDDRLLRFMVEAAGVGPEDTVLEIGPGPGLLTRYLIERAGRVVAVELDERLVEVLERELGDAENLEIVHADFLEYGVPEEVNKVVSNLPYQISSEATFEILRSDVERAVLTYQREFAERMTAEPGTRGYGRLTVMVNLLARVEVLRAVPRRAFVPPPRVSSAIVRLEPRPESELPDVDPETLEAVCRGLFQHRRKTVRNALRLSAHEWGGDEEVVEEVLRRLPEELLDKRPLHLTPEEVVRVARCVERARGSS

SEQ ID NO: 448 - protein, 167 aa, synthetic construct
  source 1..167: note = MG68-4_V1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGN

SEQ ID NO: 449 - protein, 167 aa, synthetic construct
  source 1..167: note = MG68-4_V2
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGVENPKTGACGSVMDIARHPALNHQLQVDGGVMAAPCARLLSDFFRWRRAQKKAARDNSSGN

SEQ ID NO: 450 - protein, 167 aa, synthetic construct
  source 1..167: note = MG68-4_V3
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSYFFRWRRAQKKAARDNSSGN

SEQ ID NO: 451 - protein, 167 aa, synthetic construct
  source 1..167: note = MG68-4_V4
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGAENPKTGACGSVMDIARHPALNHQLQVDGGVMAAPCARLLSDFFRWRRAQKKAARDNSSGN

SEQ ID NO: 452 - protein, 167 aa, synthetic construct
  source 1..167: note = MG68-4_V5
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARYPALNHQLQVDGGVMAAPCARLLSDFFRWRRAQKKAARDNSSGN

SEQ ID NO: 453 - protein, 167 aa, synthetic construct
  source 1..167: note = MG68-4_V6
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCNRLLSDFFRWRRAQKKAARDNSSGN

SEQ ID NO: 454 - protein, 167 aa, synthetic construct
  source 1..167: note = MG68-4_V7
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLCDFFRWRRAQKKAARDNSSGN

SEQ ID NO: 455 - protein, 167 aa, synthetic construct
  source 1..167: note = MG68-4_V8
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKNAARDNSSGN

SEQ ID NO: 456 - protein, 167 aa, synthetic construct
  source 1..167: note = MG68-4_V9
MTDSQNDTDEYWMGEALKLAQKARDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGN

SEQ ID NO: 457 - protein, 167 aa, synthetic construct
  source 1..167: note = MG68-4_V10
MTDSQNDTDEYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKTGACGSVMDIARHPALNHQLQVDGGVMAAPCARLLSDFFRWRRAQKKAARDNSSGN

SEQ ID NO: 458 - protein, 167 aa, synthetic construct
  source 1..167: note = MG68-4_V11
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKRGACGSVMDIARHPALNHQLQVDGGVMAAPCARLLSDFFRWRRAQKKAARDNSSGN

SEQ ID NO: 459 - protein, 167 aa, synthetic construct
  source 1..167: note = MG68-4_V12
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSRFFRWRRAQKKAARDNSSGN

SEQ ID NO: 460 - protein, 167 aa, synthetic construct
  source 1..167: note = MG68-4_V13
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRPAQKKAARDNSSGN

SEQ ID NO: 461 - protein, 167 aa, synthetic construct
  source 1..167: note = MG68-4_V14
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGVENPKTGACGSVMDIARHPALNHQLQVDGGVMAAPCARLLSYFFRWRRAQKKAARDNSSGN

SEQ ID NO: 462 - protein, 167 aa, synthetic construct
  source 1..167: note = MG68-4_V15
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARHPALNHQLQVDGGVMAAPCARLLSYFFRWRRAQKKAARDNSSGN

SEQ ID NO: 463 - protein, 167 aa, synthetic construct
  source 1..167: note = MG68-4_V16
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCARLLSDFFRWRRAQKKAARDNSSGN

SEQ ID NO: 464 - protein, 167 aa, synthetic construct
  source 1..167: note = MG68-4_V17
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCNRLLSYFFRWRRAQKKAARDNSSGN

SEQ ID NO: 465 - protein, 167 aa, synthetic construct
  source 1..167: note = MG68-4_V18
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCARLLCYFFRWRRAQKKAARDNSSGN

SEQ ID NO: 466 - protein, 167 aa, synthetic construct
  source 1..167: note = MG68-4_V19
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCARLLSYFFRWRRAQKNAARDNSSGN

SEQ ID NO: 467 - protein, 167 aa, synthetic construct
  source 1..167: note = MG68-4_V20
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCARLLCYFFRWRRAQKNAARDNSSGN

SEQ ID NO: 468 - protein, 167 aa, synthetic construct
  source 1..167: note = MG68-4_V21
MTDSQNDTDEYWMGEALKLAQKARDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCARLLCYFFRWRRAQKNAARDNSSGN

SEQ ID NO: 469 - protein, 167 aa, synthetic construct
  source 1..167: note = MG68-4_V22
MTDSQNDTDEYWMGEALKLAQKARDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCNRLLCYFFRWRRAQKNAARDNSSGN

SEQ ID NO: 470 - protein, 167 aa, synthetic construct
  source 1..167: note = MG68-4_V23
MTDSQNDTDEYWMGEALKLAQKARDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCNRLLCYFFRWRPAQKNAARDNSSGN

SEQ ID NO: 471 - protein, 167 aa, synthetic construct
  source 1..167: note = MG68-4_V24
MTDSQNDTDEYWMGEALKLAQKARDEGEVPVGAILVRKGEVIGHGWNRSIGSHDPSAHAEIMAIREAGVRIGNYRMLDTVLYSTFEPCAMCAGALVHGRISRLVFGVENPKTGACGSVMDIARYPALNHQLQVDGGVMAAPCNRLLCYFFRWRPAQKNAARDNSSGN

SEQ ID NO: 472 - protein, 167 aa, synthetic construct
  source 1..167: note = MG68-4_V25
MTDSQNDTDEYWMGEALKLAQKARDEGEVPVGAILVRKGEVIGHGWNRSIGSHDPSAHAEIMAIREAGVRIGNYRMLDTVLYSTFEPCAMCAGALVHGRISRLVFGVENPKTGACGSVMDIARHPALNHQLQVDGGVMAAPCNRLLCYFFRWRPAQKNAARDNSSGN

SEQ ID NO: 473 - protein, 167 aa, synthetic construct
  source 1..167: note = MG68-4_V26
MTDSQNDTDEYWMGEALKLAQKARDEGEVPVGAILVRKGEVIGHGWNRSIGSHDPSAHAEIMAIREAGVRIGNYRMLDTVLYSTFEPCAMCAGALVHGRISRLVFGVENPKTGACGSVMDIARHPALNHQLQVDGGVMAAPCNRLLCRFFRWRPAQKNAARDNSSGN

SEQ ID NO: 474 - protein, 167 aa, synthetic construct
  source 1..167: note = MG68-4_V27
MTDSQNDTDEYWMGEALKLAQKARDEGEVPVGAILVRKGEVIGHGWNRSIGSHDPSAHAEIMAIREAGVRIGNYRMLDTVLYSTFEPCAMCAGALVHGRISRLVFGVENPKRGACGSVMDIARHPALNHQLQVDGGVMAAPCNRLLCRFFRWRPAQKNAARDNSSGN

SEQ ID NO: 475 - protein, 167 aa, synthetic construct
  source 1..167: note = MG68-4_V28
MTDSQNDTDEYWMGEALKLAQKARDEGEVPVGAILVRKGEVIGHGWNRSIGSHDPSAHAEIMAIREAGVRIGNYRMLDTVLYSTFEPCAMCAGALVHGRISRLVFGVENPKRGACGSVMDIARHPALNHQLQVDGGVMAAPCNRLLCDFFRWRPAQKNAARDNSSGN

SEQ ID NO: 476 - protein, 962 aa, synthetic construct
  source 1..962: note = MG68-4_V1-nMG34-1 (D10A)
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEGSGGSPKKKRKV

SEQ ID NO: 477 - protein, 1589 aa, synthetic construct
  source 1..1589: note = MG68-4_V1-nSpCas9 (D10A)
MGSSHHHHHHMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGSSGGSSGSETPGTSESATPESSGGSSGGSMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGGSPKKKRKV

SEQ ID NO: 478 - protein, 1361 aa, synthetic construct
  source 1..1361: note = rAPOBEC1-nMG15-1 (D8A)
MGSSHHHHHHGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGMNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFRSGGSSSGGGASSGGSPKKKRKV

SEQ ID NO: 479 - protein, 1441 aa, synthetic construct
  source 1..1441: note = rAPOBEC1-nMG15-1 (D8A)-UGI (PBS1)
MGSSHHHHHHGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGMNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFRSGGSSRTNLSDIIEKETGKQLVIQESILMLPEEVEEVIGNKPESDILVHTAYDESTDENVMLLTSDAPEYKPWALVIQDSNGENKIKMLASSGGSPKKKRKV

SEQ ID NO: 480 - protein, 1442 aa, synthetic construct
  source 1..1442: note = rAPOBEC1-nMG15-1 (D8A)-MG69-1
MGSSHHHHHHGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGMNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFRSGGSSSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 481 - protein, 1443 aa, synthetic construct
  source 1..1443: note = rAPOBEC1-nMG15-1 (D8A)-MG69-2
MGSSHHHHHHGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGMNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFRSGGSSSKTIKDLEEFAAEKLGYDIVFQESISMEPQEVEHLITTDEKSVLVNSTYDDDKEITISVISTPHPEYRPIALVIQDMEGEVQRKELYGSGGSPKKKRKV

SEQ ID NO: 482 - protein, 1422 aa, synthetic construct
  source 1..1422: note = rAPOBEC1-nMG15-1 (D8A)-MG69-
MGSSHHHHHHGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGMNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFRSGGSSIVRVTYNVEQEVEISNKFNKDVDIMKPEEYDDYIDDLMFALNEKLPEYAEISCVINDNTGEVLFEGGSGGSPKKKRKV

SEQ ID NO: 483 - DNA, 10943 bp, synthetic construct
  source 1..10943: mol_type = other DNA; note = pET21-CAT (H193Y)-sgRNA-TadA-nSpCas9 (D10A)
gaaataattttgtttaactttaagaaggagatataccatgggcagcagtcatcatcatcaccatcacatgtctgaagtcgaatttagccacgaatactggatgcgtcacgcgctgacgctggcgaaacgtgcctgggatgagcgggaagtgccggtcggcgcggtattagtgcataacaatcgggtaatcggcgaaggctggaaccgcccgattggtcgccatgatcccaccgcacatgcagaaatcatggccctgcggcagggtggtctggtgatgcaaaattatcgtctgatcgacgccacgttgtatgtcacgcttgaaccatgtgtaatgtgtgccggagcgatgatccacagtcgcattggtcgcgtggtctttggtgcgcgtgacgcgaaaactggcgctgcgggatctttaatggatgtgctgcatcatccgggtatgaatcaccgagtggaaattacggaaggaatactggcggatgagtgcgcggcgttgctcagtgacttctttcgcatgcgccgccaggaaattaaagcgcagaaaaaagcgcaatcctcgacggattcaggcgggtcgtcgggaggaagcagtggcagcgagactcccggaacttcggagagcgctacaccagaaagtagtggaggcagctctggtgggtccatggataagaaatactcaataggactggcgattggcacaaatagcgtcggatgggctgtgatcactgatgaatataaggttccttctaaaaagttcaaggttctgggaaatacagaccgccacagtatcaaaaaaaatcttataggggctcttctgtttgacagtggagagacagccgaagctactagactcaaacggacagctaggagaaggtatacaagacggaagaataggatttgttatctccaggagattttttcaaatgagatggccaaagtggatgatagtttctttcatagacttgaagagtcttttttggtggaagaagacaagaagcatgaaagacatcctatttttggaaatatagtggatgaagttgcttatcacgagaaatatccaactatctatcatctgagaaaaaaattggtggattctactgataaagccgatttgcgcctgatctatttggccctggcccacatgattaagtttagaggtcattttttgattgagggcgatctgaatcctgataatagtgatgtggacaaactgtttatccagttggtgcaaacctacaatcaactgtttgaagaaaaccctattaacgcaagtggagtggatgctaaagccattctttctgcaagattgagtaaatcaagaagactggaaaatctcattgctcagctccccggtgagaagaaaaatggcctgtttgggaatctcattgctttgtcattgggtttgacccctaattttaaatcaaattttgatttggcagaagatgctaaactccagctttcaaaagatacttacgatgatgatctggataatctgttggctcaaattggagatcaatatgctgatttgtttttggcagctaagaatctgtcagatgctattctgctttcagacatcctgagagtgaatactgaaataactaaggctcccctgtcagcttcaatgattaaacgctacgatgaacatcatcaagacttgactcttctgaaagccctggttagacaacaacttccagaaaagtataaagaaatcttttttgatcaatcaaaaaacggatatgcaggttatattgatggcggcgcaagccaagaagaattttataaatttatcaaaccaattctggaaaaaatggatggtactgaggaactgttggtgaaactgaatagagaagatttgctgcgcaagcaacggacctttgacaacggctctattccccatcaaattcacttgggtgagctgcatgctattttgagaagacaagaagacttttatccatttctgaaagacaatagagagaagattgaaaaaatcttgacttttaggattccttattatgttggtccattggccagaggcaatagtaggtttgcatggatgactcggaagtctgaagaaacaattaccccatggaattttgaagaagttgtcgataaaggtgcttcagctcaatcatttattgaacgcatgacaaactttgataaaaatcttccaaatgaaaaagtgctgccaaaacatagtttgctttatgagtattttaccgtttataacgaattgacaaaggtcaaatatgttactgaaggaatgagaaaaccagcatttctttcaggtgaacagaagaaagccattgttgatctgctcttcaaaacaaataggaaagtgaccgttaagcaactgaaagaagattatttcaaaaaaatagaatgttttgatagtgttgaaatttcaggagttgaagatagatttaatgcttcactgggtacataccatgatttgctgaaaattattaaagataaagattttttggataatgaagaaaatgaagacatcctggaggatattgttctgacattgaccctgtttgaagatagggagatgattgaggaaagacttaaaacatacgctcacctctttgatgataaggtgatgaaacagcttaaaagacgcagatatactggttggggaaggttgtccagaaaattgattaatggtattagggataagcaatctggcaaaacaatactggattttttgaaatcagatggttttgccaatcgcaattttatgcagctcatccatgatgatagtttgacatttaaagaagacatccaaaaagcacaagtgtctggacaaggcgatagtctgcatgaacatattgcaaatctggctggtagccctgctattaaaaaaggtattctccagactgtgaaagttgttgatgaattggtcaaagtgatggggcggcataagccagaaaatatcgttattgaaatggcaagagaaaatcagacaactcaaaagggccagaaaaattccagagagaggatgaaaagaatcgaagaaggtatcaaagaactgggaagtcagattcttaaagagcatcctgttgaaaatactcaattgcaaaatgaaaagctctatctctattatctccaaaatggaagagatatgtatgtggaccaagaactggatattaataggctgagtgattatgatgtcgatcacattgttccacaaagtttccttaaagacgattcaatagacaataaggtcctgaccaggtctgataaaaatagaggtaaatccgataacgttccaagtgaagaagtggtcaaaaagatgaaaaactattggagacaacttctgaacgccaagctgatcactcaaaggaagtttgataatctgaccaaagctgaaagaggaggtttgagtgaacttgataaagctggttttatcaaacgccaattggttgaaactcgccaaatcactaagcatgtggcacaaattttggatagtcgcatgaatactaaatacgatgaaaatgataaacttattagagaggttaaagtgattaccctgaaatctaaactggtttctgacttcagaaaagatttccaattctataaagtgagagagattaacaattaccatcatgcccatgatgcctatctgaatgccgtcgttggaactgctttgattaagaaatatccaaaacttgaaagcgagtttgtctatggtgattataaagtttatgatgttaggaaaatgattgctaagtctgagcaagaaataggcaaagcaaccgcaaagtatttcttttactctaatatcatgaacttcttcaaaacagaaattacacttgcaaatggagagattcgcaaacgccctctgatcgaaactaatggggaaactggagaaattgtctgggataaagggagagattttgccacagtgcgcaaagtgttgtccatgccccaagtcaatatcgtcaagaaaacagaagtgcagacaggcggattctctaaggagtcaattctgccaaaaagaaattccgacaagctgattgctaggaaaaaagactgggacccaaaaaaatatggtggttttgatagtccaaccgtggcttattcagtcctggtggttgctaaggtggaaaaagggaaatccaagaagctgaaatccgttaaagagctgctggggatcacaattatggaaagaagttcctttgaaaaaaatcccattgactttctggaagctaaaggatataaggaagttaaaaaagacctgatcattaaactgcctaaatatagtctttttgagctggaaaacggtaggaaacggatgctggctagtgccggagaactgcaaaaaggaaatgagctggctctgccaagcaaatatgtgaattttctgtatctggctagtcattatgaaaagttgaagggtagtccagaagataacgaacaaaaacaattgtttgtggagcagcataagcattatctggatgagattattgagcaaatcagtgaattttctaagagagttattctggcagatgccaatctggataaagttcttagtgcatataacaaacatagagacaaaccaataagagaacaagcagaaaatatcattcatctgtttaccttgaccaatcttggagcacccgctgcttttaaatactttgatacaacaattgataggaaaagatatacctctacaaaagaagttctggatgccactcttatccatcaatccatcactggtctttatgaaacacgcattgatttgagtcagctgggaggtgacggctctggcgggtctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaatttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgttttttgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcattatgccgtctgtgatggcttccatgtcggcagaatgcttaatgaattacaacagtactgcgatgagtggcagggcggggcgtaatttttttaaggcagttattggtgcccttaaacgcctggtgctacgcctgaataagtgaagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatcc

SEQ ID NO: 484 - DNA, 8520 bp, synthetic construct
  source 1..8520: mol_type = other DNA; note = pET21-sgRNA-TadA (ABE8.17m)-nMG34-1 (D10A)
gaaataattttgtttaactttaagaaggagatataccatgggcagcagtcatcatcatcaccatcactccgaggttgaatttagtcatgaatattggatgcgccacgcgctgacgttagccaaacgtgctcgtgatgagcgcgaagttccagtcggggccgtcttggtccttaacaatcgtgtcattggcgaggggtggaaccgcgctattgggctgcacgatccaacagcgcatgctgagattatggccttgcgtcaaggagggttagtaatgcaaaactaccgtcttattgatgctacgttatactctacattcgaaccctgtgtaatgtgtgcaggagcgatgatccacagtcgtattggccgcgtagtatttggtgtacgcaatgctaaaactggagccgccggatcgttgatggatgtcttgcattaccctggaatgaaccatcgtgtagagatcactgaaggcatccttgccgatgagtgtgcggctttgctttgctatttcttccgtatgccacgtcgtgtttttaacgcccaaaaaaaggctcaatccagtaccgattcaggcgggtcgtcgggaggaagcagtggcagcgagactcccggaacttcggagagcgctacaccagaaagtagtggaggcagctctggtgggtccatggagcgcgagctggtgctggggatcgcgtatggtggtaagtacacgggcttggcggtggtggatcgccgccacaaccaagtgctgtacgcgaatcgtcttaaaatgcgtgatgacgtggcaggcatcttgaaggaccgtcgcaaacagcgcgggattcgtcgcacggcccagacgaagaagaaacgccttcgcgagctgaagaattacctgaagagcatcgggtacaatgagtcgacggccaccttcgagaccgtgtattcactggcgcacaagcgtggttacgactacgcagacatgccagaggagaaaaccagtgaggagattgaagcgatggacgttgaggaacgtaagcaatgggagaaggaaaagcaagagtgggaagaaactaagcgcaactctcgccatcgcaaagaggtagttaaggacgtacacaaggcgatgatcgagggccgtgccacggaagaacaaattaagcgtgtggagcgcatcttcaacaagcaatatcgcccgaagcgttttaacaaccgcatcttgaccaagtgcaaagtggaagactgtggtgtgaacactcctttgcgtaagaacgtacgcgacctgctgattgagaacattgttcgtttctttccgattgagcagagcgagaaagacaacctgaaggacgccgtattagacaagaatcgtcgcgaagaggtgaagtccttctttcgcaagcacaaaaccgacgagcacatccgtaaacaagtgtacgacattgccgacaataaactgagcgggcgtactgtattctgcaaggagcacattctggagcacacggaacactccaaggaagagcgtaaagtctttcgcctggcaccgagtctgaagacgaagattgaaaacgtgctggcagtaatcaaggatgaaattctccctaagttcacggtgaacaaagtagtgatggaatcaaataacttcgacatcgccgcgaagacccaaggtaagaagcgtctcgccaaggaagagtacggcaagggcccgcgtgagggtaaggaaacgcgcaaagaggcgctgctgcgcgagaccgacgggcgctgcatttattgcggcaagagcatcgatatttcgaacgcacacgacgatcacatcttccctcgtaaagcgggcggattgaacattttcgcgaacctcgtggcctgctgtgcggtgtgcaacgaaaacaagaagggccgcacgcctctggagtcgggcatttcaccaaagccagagattattgcatttatgaagaacgacctgaagaagaaaatcttggaagatgctcgcaacattaacaccgtcgacttcaacaagtatatgagccacgcttcgattgggtggcgttacatgcgcgatcgccttcgcgaatcggcaggtaacaagaaactgccgatcgaacgccaaagtggtatttatacggcctactttcgtcgctggtggggtttcaagaaagagcgcggtaatactttgcaccacgctctggacgcggtgattttggcctcgcgtaagggctactcagacgacggcttagtagacatgactttaaaacccaagtacaataagggcggcgaattcgatccggagaagcacttaccggagcctatcgagttcaagatggacaaggggtcacgcggtagcgccctgcacgaccgtaatccgttgagttacaagaagggtatcatcactcgtcgcttcatggtcactgaaatcgaatgtggcaaggaagatgacgtgatctctgaaacctaccgcgagaagttgaaggaagcgttcaagcgcttcgacaccaagaagggcaagtgcctgaccgataaagaagccaaagaggcggggttctgtatcaagaagaacgagctggtgatgtcgctgaagtgttcaatcaaggggactggcccgggccaaatgattcgcattaacaacaacgtgttcaaaaccaacgtacacaacgtaggagttgacgtctacctggacgagaagggcaagaagaaggcgtacgaacgcaagaacccacgcttatcgaagcattttattgagccgccgccacaaccgaacggccgcgtctctttcacactgaagcgtcgcgacatggtgactgtagagggagaggatgccatttaccgcattaagaagttgggtacttccccgaccatcgaggcggtggtggggagcgacggtaagacgcgcacagtatcggcaacgaaattgaccaaggccaatagcgccgagctcgagggctctggcgggtctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaattacggccagtcatgcataatccgcacgcatctggaataaggaagtgccattccgcctgaccttaatacgactcactatagtctttatggcagggtgaaacgcgttacagttaagaaattaattgtaaaacgcctatacagtgaagggatatacgcttgggtttgtccagcctgagcctctatgccagaaatggcgccttcatcgtgggttaggacatttaattttaaaaaaaaaccccgcttcggcggggtttttttttagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatcc

SEQ ID NO: 485 - DNA, 8925 bp, synthetic construct
  source 1..8925: mol_type = other DNA; note = pET21-sgRNA-rAPOBEC1-nMG34-1 (D10A)-UGI (PBS1)
atgggcagcagtcatcatcatcaccatcacatgtcgtctgagaccgggcctgttgccgtggaccctacccttcgccgccgtatcgaaccacacgagtttgaagtgttttttgacccacgcgaactgcgcaaagagacttgtttgctttacgagattaactggggaggccgtcactccatctggcgtcacacttcacaaaatactaataagcacgttgaggttaatttcattgagaaatttactacagagcgctacttctgtccgaatacacgttgcagcatcacctggtttctttcctggtccccgtgcggtgaatgttcacgtgccatcaccgaattcttatcgcgctaccctcacgtaactttgtttatctatattgcccgtttatatcaccatgcagaccctcgcaatcgtcagggcctgcgcgaccttatctcgagtggagtcaccatccaaattatgactgaacaggaatcggggtattgttggcgcaactttgtcaattattctccgagcaacgaggcacattggccgcgttacccacacttatgggtgcgcctttacgtgctggaattgtattgcatcattcttggtcttcccccatgtttgaatatccttcgccgcaaacagcctcagttgacgttttttacgattgctcttcagtcctgtcactaccaacgtcttcccccgcacatcctgtgggcgaccggtttgaaatcggggagtgaaacacccggcacatccgaaagtgcgacacctgaatctgccatggagcgcgagctggtgctggggatcgcgtatggtggtaagtacacgggcttggcggtggtggatcgccgccacaaccaagtgctgtacgcgaatcgtcttaaaatgcgtgatgacgtggcaggcatcttgaaggaccgtcgcaaacagcgcgggattcgtcgcacggcccagacgaagaagaaacgccttcgcgagctgaagaattacctgaagagcatcgggtacaatgagtcgacggccaccttcgagaccgtgtattcactggcgcacaagcgtggttacgactacgcagacatgccagaggagaaaaccagtgaggagattgaagcgatggacgttgaggaacgtaagcaatgggagaaggaaaagcaagagtgggaagaaactaagcgcaactctcgccatcgcaaagaggtagttaaggacgtacacaaggcgatgatcgagggccgtgccacggaagaacaaattaagcgtgtggagcgcatcttcaacaagcaatatcgcccgaagcgttttaacaaccgcatcttgaccaagtgcaaagtggaagactgtggtgtgaacactcctttgcgtaagaacgtacgcgacctgctgattgagaacattgttcgtttctttccgattgagcagagcgagaaagacaacctgaaggacgccgtattagacaagaatcgtcgcgaagaggtgaagtccttctttcgcaagcacaaaaccgacgagcacatccgtaaacaagtgtacgacattgccgacaataaactgagcgggcgtactgtattctgcaaggagcacattctggagcacacggaacactccaaggaagagcgtaaagtctttcgcctggcaccgagtctgaagacgaagattgaaaacgtgctggcagtaatcaaggatgaaattctccctaagttcacggtgaacaaagtagtgatggaatcaaataacttcgacatcgccgcgaagacccaaggtaagaagcgtctcgccaaggaagagtacggcaagggcccgcgtgagggtaaggaaacgcgcaaagaggcgctgctgcgcgagaccgacgggcgctgcatttattgcggcaagagcatcgatatttcgaacgcacacgacgatcacatcttccctcgtaaagcgggcggattgaacattttcgcgaacctcgtggcctgctgtgcggtgtgcaacgaaaacaagaagggccgcacgcctctggagtcgggcatttcaccaaagccagagattattgcatttatgaagaacgacctgaagaagaaaatcttggaagatgctcgcaacattaacaccgtcgacttcaacaagtatatgagccacgcttcgattgggtggcgttacatgcgcgatcgccttcgcgaatcggcaggtaacaagaaactgccgatcgaacgccaaagtggtatttatacggcctactttcgtcgctggtggggtttcaagaaagagcgcggtaatactttgcaccacgctctggacgcggtgattttggcctcgcgtaagggctactcagacgacggcttagtagacatgactttaaaacccaagtacaataagggcggcgaattcgatccggagaagcacttaccggagcctatcgagttcaagatggacaaggggtcacgcggtagcgccctgcacgaccgtaatccgttgagttacaagaagggtatcatcactcgtcgcttcatggtcactgaaatcgaatgtggcaaggaagatgacgtgatctctgaaacctaccgcgagaagttgaaggaagcgttcaagcgcttcgacaccaagaagggcaagtgcctgaccgataaagaagccaaagaggcggggttctgtatcaagaagaacgagctggtgatgtcgctgaagtgttcaatcaaggggactggcccgggccaaatgattcgcattaacaacaacgtgttcaaaaccaacgtacacaacgtaggagttgacgtctacctggacgagaagggcaagaagaaggcgtacgaacgcaagaacccacgcttatcgaagcattttattgagccgccgccacaaccgaacggccgcgtctctttcacactgaagcgtcgcgacatggtgactgtagagggagaggatgccatttaccgcattaagaagttgggtacttccccgaccatcgaggcggtggtggggagcgacggtaagacgcgcacagtatcggcaacgaaattgaccaaggccaatagcgccgagctcgaggggtctggtggttctaccaatctttcagatattattgaaaaagagacaggaaagcagttggtcattcaagagagtatcctgatgttaccggaggaagttgaggaggtaatcggaaataaacccgagagcgacattttagtccacactgcttatgacgagagtacggatgagaatgtgatgctgcttacgtcagatgcgcccgagtataagccgtgggccctggtcattcaggacagtaacggcgaaaacaagatcaaaatgctttctggtggttctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaattacggccagtcatgcataatccgcacgcatctggaataaggaagtgccattccgcctgaccttaatacgactcactatagcgcgccggagaaaaccgcctcggttacagttaagaaattaattgtaaaacgcctatacagtgaagggatatacgcttgggtttgtccagcctgagcctctatgccagaaatggcgccttcatcgtgggttaggacatttaattttaaaaaaaaaccccgcttcggcggggtttttttttagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatccgaaataattttgtttaactttaagaaggagatatacc

SEQ ID NO: 486 - DNA, 9519 bp, synthetic construct
  source 1..9519: mol_type = other DNA; note = pET21-CAT (H193Y)-sgRNA-MG68-4 (D109N)-nMG34-1 (D10A)
ttaattaatttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgttttttgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcattatgccgtctgtgatggcttccatgtcggcagaatgcttaatgaattacaacagtactgcgatgagtggcagggcggggcgtaatttttttaaggcagttattggtgcccttaaacgcctggtgctacgcctgaataagtgaagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgactcgagtgcggccgcaagcttgtcgacggagctcgaattcggatcctaatacgactcactatagtaatgaacctgaatcgccaggttacagttaagaaattaattgtaaaacgcctatacagtgaagggatatacgcttgggtttgtccagcctgagcctctatgccagaaatggcgccttcatcgtgggttaggacatttaattttaaaaaaaaaccccgcttcggcggggtttttttttagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatccgaaataattttgtttaactttaagaaggagatataccccgcggatgactgattctcaaaatgatacagatgaatactggatgggagaggccctgaagttggcacaaaaggcatgggacgaaggagaggtgcccgtaggagccatcttggttcgtaagggcgaagttatcggtcatggctggaaccgtagcatcgggtcccatgacccctcggcgcatgctgaaattatggctattcgtgaagccggggtgcgtatcggtaattatcgcatgttggataccgtattatacgttacgctggagccgtgtgcaatgtgcgcaggggcacttgttcacgggcgtatttcacgcttggtctttggtgccgaaaaccccaagacaggggcgtgcgggtcagtcatggacattgctcgccaccctgctttgaaccaccaattacaagttgatggtggggtaatggcggctccttgtgcgcgtcttttatctgacttctttcgctggcgtcgcgctcagaaaaaggcggcccgtgataatagttcggggaacggtacctcaggcgggtcgtcgggaggaagcagtggcagcgagactcccggaacttcggagagcgctacaccagaaagtagtggaggcagctctggtgggtccatggagcgcgagctggtgctggggatcgcgtatggtggtaagtacacgggcttggcggtggtggatcgccgccacaaccaagtgctgtacgcgaatcgtcttaaaatgcgtgatgacgtggcaggcatcttgaaggaccgtcgcaaacagcgcgggattcgtcgcacggcccagacgaagaagaaacgccttcgcgagctgaagaattacctgaagagcatcgggtacaatgagtcgacggccaccttcgagaccgtgtattcactggcgcacaagcgtggttacgactacgcagacatgccagaggagaaaaccagtgaggagattgaagcgatggacgttgaggaacgtaagcaatgggagaaggaaaagcaagagtgggaagaaactaagcgcaactctcgccatcgcaaagaggtagttaaggacgtacacaaggcgatgatcgagggccgtgccacggaagaacaaattaagcgtgtggagcgcatcttcaacaagcaatatcgcccgaagcgttttaacaaccgcatcttgaccaagtgcaaagtggaagactgtggtgtgaacactcctttgcgtaagaacgtacgcgacctgctgattgagaacattgttcgtttctttccgattgagcagagcgagaaagacaacctgaaggacgccgtattagacaagaatcgtcgcgaagaggtgaagtccttctttcgcaagcacaaaaccgacgagcacatccgtaaacaagtgtacgacattgccgacaataaactgagcgggcgtactgtattctgcaaggagcacattctggagcacacggaacactccaaggaagagcgtaaagtctttcgcctggcaccgagtctgaagacgaagattgaaaacgtgctggcagtaatcaaggatgaaattctccctaagttcacggtgaacaaagtagtgatggaatcaaataacttcgacatcgccgcgaagacccaaggtaagaagcgtctcgccaaggaagagtacggcaagggcccgcgtgagggtaaggaaacgcgcaaagaggcgctgctgcgcgagaccgacgggcgctgcatttattgcggcaagagcatcgatatttcgaacgcacacgacgatcacatcttccctcgtaaagcgggcggattgaacattttcgcgaacctcgtggcctgctgtgcggtgtgcaacgaaaacaagaagggccgcacgcctctggagtcgggcatttcaccaaagccagagattattgcatttatgaagaacgacctgaagaagaaaatcttggaagatgctcgcaacattaacaccgtcgacttcaacaagtatatgagccacgcttcgattgggtggcgttacatgcgcgatcgccttcgcgaatcggcaggtaacaagaaactgccgatcgaacgccaaagtggtatttatacggcctactttcgtcgctggtggggtttcaagaaagagcgcggtaatactttgcaccacgctctggacgcggtgattttggcctcgcgtaagggctactcagacgacggcttagtagacatgactttaaaacccaagtacaataagggcggcgaattcgatccggagaagcacttaccggagcctatcgagttcaagatggacaaggggtcacgcggtagcgccctgcacgaccgtaatccgttgagttacaagaagggtatcatcactcgtcgcttcatggtcactgaaatcgaatgtggcaaggaagatgacgtgatctctgaaacctaccgcgagaagttgaaggaagcgttcaagcgcttcgacaccaagaagggcaagtgcctgaccgataaagaagccaaagaggcggggttctgtatcaagaagaacgagctggtgatgtcgctgaagtgttcaatcaaggggactggcccgggccaaatgattcgcattaacaacaacgtgttcaaaaccaacgtacacaacgtaggagttgacgtctacctggacgagaagggcaagaagaaggcgtacgaacgcaagaacccacgcttatcgaagcattttattgagccgccgccacaaccgaacggccgcgtctctttcacactgaagcgtcgcgacatggtgactgtagagggagaggatgccatttaccgcattaagaagttgggtacttccccgaccatcgaggcggtggtggggagcgacggtaagacgcgcacagtatcggcaacgaaattgaccaaggccaatagcgccgagctcgagggctctggcgggtctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaattctaga

SEQ ID NO: 487 - DNA, 11211 bp, synthetic construct
  source 1..11211: mol_type = other DNA; note = pET21-CAT (H193Y)-sgRNA-MG68-4 (D109N)-nSpCas9 (D10A)
gaaataattttgtttaactttaagaaggagatataccatgggcagcagtcatcatcatcaccatcacatgactgattctcaaaatgatacagatgaatactggatgggagaggccctgaagttggcacaaaaggcatgggacgaaggagaggtgcccgtaggagccatcttggttcgtaagggcgaagttatcggtcatggctggaaccgtagcatcgggtcccatgacccctcggcgcatgctgaaattatggctattcgtgaagccggggtgcgtatcggtaattatcgcatgttggataccgtattatacgttacgctggagccgtgtgcaatgtgcgcaggggcacttgttcacgggcgtatttcacgcttggtctttggtgccgaaaaccccaagacaggggcgtgcgggtcagtcatggacattgctcgccaccctgctttgaaccaccaattacaagttgatggtggggtaatggcggctccttgtgcgcgtcttttatctgacttctttcgctggcgtcgcgctcagaaaaaggcggcccgtgataatagttcggggaactcaggcgggtcgtcgggaggaagcagtggcagcgagactcccggaacttcggagagcgctacaccagaaagtagtggaggcagctctggtgggtccatggataagaaatactcaataggactggcgattggcacaaatagcgtcggatgggctgtgatcactgatgaatataaggttccttctaaaaagttcaaggttctgggaaatacagaccgccacagtatcaaaaaaaatcttataggggctcttctgtttgacagtggagagacagccgaagctactagactcaaacggacagctaggagaaggtatacaagacggaagaataggatttgttatctccaggagattttttcaaatgagatggccaaagtggatgatagtttctttcatagacttgaagagtcttttttggtggaagaagacaagaagcatgaaagacatcctatttttggaaatatagtggatgaagttgcttatcacgagaaatatccaactatctatcatctgagaaaaaaattggtggattctactgataaagccgatttgcgcctgatctatttggccctggcccacatgattaagtttagaggtcattttttgattgagggcgatctgaatcctgataatagtgatgtggacaaactgtttatccagttggtgcaaacctacaatcaactgtttgaagaaaaccctattaacgcaagtggagtggatgctaaagccattctttctgcaagattgagtaaatcaagaagactggaaaatctcattgctcagctccccggtgagaagaaaaatggcctgtttgggaatctcattgctttgtcattgggtttgacccctaattttaaatcaaattttgatttggcagaagatgctaaactccagctttcaaaagatacttacgatgatgatctggataatctgttggctcaaattggagatcaatatgctgatttgtttttggcagctaagaatctgtcagatgctattctgctttcagacatcctgagagtgaatactgaaataactaaggctcccctgtcagcttcaatgattaaacgctacgatgaacatcatcaagacttgactcttctgaaagccctggttagacaacaacttccagaaaagtataaagaaatcttttttgatcaatcaaaaaacggatatgcaggttatattgatggcggcgcaagccaagaagaattttataaatttatcaaaccaattctggaaaaaatggatggtactgaggaactgttggtgaaactgaatagagaagatttgctgcgcaagcaacggacctttgacaacggctctattccccatcaaattcacttgggtgagctgcatgctattttgagaagacaagaagacttttatccatttctgaaagacaatagagagaagattgaaaaaatcttgacttttaggattccttattatgttggtccattggccagaggcaatagtaggtttgcatggatgactcggaagtctgaagaaacaattaccccatggaattttgaagaagttgtcgataaaggtgcttcagctcaatcatttattgaacgcatgacaaactttgataaaaatcttccaaatgaaaaagtgctgccaaaacatagtttgctttatgagtattttaccgtttataacgaattgacaaaggtcaaatatgttactgaaggaatgagaaaaccagcatttctttcaggtgaacagaagaaagccattgttgatctgctcttcaaaacaaataggaaagtgaccgttaagcaactgaaagaagattatttcaaaaaaatagaatgttttgatagtgttgaaatttcaggagttgaagatagatttaatgcttcactgggtacataccatgatttgctgaaaattattaaagataaagattttttggataatgaagaaaatgaagacatcctggaggatattgttctgacattgaccctgtttgaagatagggagatgattgaggaaagacttaaaacatacgctcacctctttgatgataaggtgatgaaacagcttaaaagacgcagatatactggttggggaaggttgtccagaaaattgattaatggtattagggataagcaatctggcaaaacaatactggattttttgaaatcagatggttttgccaatcgcaattttatgcagctcatccatgatgatagtttgacatttaaagaagacatccaaaaagcacaagtgtctggacaaggcgatagtctgcatgaacatattgcaaatctggctggtagccctgctattaaaaaaggtattctccagactgtgaaagttgttgatgaattggtcaaagtgatggggcggcataagccagaaaatatcgttattgaaatggcaagagaaaatcagacaactcaaaagggccagaaaaattccagagagaggatgaaaagaatcgaagaaggtatcaaagaactgggaagtcagattcttaaagagcatcctgttgaaaatactcaattgcaaaatgaaaagctctatctctattatctccaaaatggaagagatatgtatgtggaccaagaactggatattaataggctgagtgattatgatgtcgatcacattgttccacaaagtttccttaaagacgattcaatagacaataaggtcctgaccaggtctgataaaaatagaggtaaatccgataacgttccaagtgaagaagtggtcaaaaagatgaaaaactattggagacaacttctgaacgccaagctgatcactcaaaggaagtttgataatctgaccaaagctgaaagaggaggtttgagtgaacttgataaagctggttttatcaaacgccaattggttgaaactcgccaaatcactaagcatgtggcacaaattttggatagtcgcatgaatactaaatacgatgaaaatgataaacttattagagaggttaaagtgattaccctgaaatctaaactggtttctgacttcagaaaagatttccaattctataaagtgagagagattaacaattaccatcatgcccatgatgcctatctgaatgccgtcgttggaactgctttgattaagaaatatccaaaacttgaaagcgagtttgtctatggtgattataaagtttatgatgttaggaaaatgattgctaagtctgagcaagaaataggcaaagcaaccgcaaagtatttcttttactctaatatcatgaacttcttcaaaacagaaattacacttgcaaatggagagattcgcaaacgccctctgatcgaaactaatggggaaactggagaaattgtctgggataaagggagagattttgccacagtgcgcaaagtgttgtccatgccccaagtcaatatcgtcaagaaaacagaagtgcagacaggcggattctctaaggagtcaattctgccaaaaagaaattccgacaagctgattgctaggaaaaaagactgggacccaaaaaaatatggtggttttgatagtccaaccgtggcttattcagtcctggtggttgctaaggtggaaaaagggaaatccaagaagctgaaatccgttaaagagctgctggggatcacaattatggaaagaagttcctttgaaaaaaatcccattgactttctggaagctaaaggatataaggaagttaaaaaagacctgatcattaaactgcctaaatatagtctttttgagctggaaaacggtaggaaacggatgctggctagtgccggagaactgcaaaaaggaaatgagctggctctgccaagcaaatatgtgaattttctgtatctggctagtcattatgaaaagttgaagggtagtccagaagataacgaacaaaaacaattgtttgtggagcagcataagcattatctggatgagattattgagcaaatcagtgaattttctaagagagttattctggcagatgccaatctggataaagttcttagtgcatataacaaacatagagacaaaccaataagagaacaagcagaaaatatcattcatctgtttaccttgaccaatcttggagcacccgctgcttttaaatactttgatacaacaattgataggaaaagatatacctctacaaaagaagttctggatgccactcttatccatcaatccatcactggtctttatgaaacacgcattgatttgagtcagctgggaggtgacggctctggcgggtctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaatttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgttttttgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcattatgccgtctgtgatggcttccatgtcggcagaatgcttaatgaattacaacagtactgcgatgagtggcagggcggggcgtaatttttttaaggcagttattggtgcccttaaacgcctggtgctacgcctgaataagtgaagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgactcgagtgcggccgcaagcttgtcgacggagctcgaattcggatcctaatacgactcactatagtaatgaacctgaatcgccaggttttagagctagaaatagcaagttaaaataaggctagtccgttatcaacttgaaaaagtggcaccgagtcggtgcttttttgtgaacctgcaggaggcatcaaataaaacgaaaggctcagtcgaaagactgggcctttcgttttatctgttgtttgtcggtgaacgctctcctgagtaggacaaattcgatcccgcgaaattaatacgactcactataggggaattgtgagcggataacaattcccctctaggatcc

SEQ ID NO: 488 - DNA, 96 bp, synthetic construct
  source 1..96: mol_type = other DNA; note = MG15-1
gttgtaattccctagaaataggttattacaataaggtccaacaggagtgttggtaccgtaaagctctaacggcacccacgggtgccgttatctttt

SEQ ID NO: 489 - DNA, 123 bp, synthetic construct
  source 1..123: mol_type = other DNA; note = MG34-1
gttacagttaagaaattaattgtaaaacgcctatacagtgaagggatatacgcttgggtttgtccagcctgagcctctatgccagaaatggcgccttcatcgtgggttaggacatttaatttt

SEQ ID NO: 490 - DNA, 22 bp, synthetic construct
  source 1..22: mol_type = other DNA; note = rAPOBEC1-nMG15-1 (D8A) in E. coli
gatccgcgctggctaccggcga

SEQ ID NO: 491 - DNA, 22 bp, synthetic construct
  source 1..22: mol_type = other DNA; note = rAPOBEC1-nMG15-1 (D8A)-UGI (PBS1) in E. coli
gatccgcgctggctaccggcga

SEQ ID NO: 492 - DNA, 22 bp, synthetic construct
  source 1..22: mol_type = other DNA; note = rAPOBEC1-nMG15-1 (D8A)-MG69-1 in E. coli
gatccgcgctggctaccggcga

SEQ ID NO: 493 - DNA, 22 bp, synthetic construct
  source 1..22: mol_type = other DNA; note = rAPOBEC1-nMG15-1 (D8A)-MG69-2 in E. coli
gatccgcgctggctaccggcga

SEQ ID NO: 494 - DNA, 22 bp, synthetic construct
  source 1..22: mol_type = other DNA; note = rAPOBEC1-nMG15-1 (D8A)-MG69-3 in E. coli
gatccgcgctggctaccggcga

SEQ ID NO: 495 - DNA, 20 bp, synthetic construct
  source 1..20: mol_type = other DNA; note = rAPOBEC1-nSpCas9 (D10A)-UGI (PBS1) in HEK293T
ggcccagactgagcacgtga

SEQ ID NO: 496 - DNA, 20 bp, synthetic construct
  source 1..20: mol_type = other DNA; note = rAPOBEC1-nSpCas9 (D10A) in HEK293T
ggcccagactgagcacgtga

SEQ ID NO: 497 - DNA, 20 bp, synthetic construct
  source 1..20: mol_type = other DNA; note = rAPOBEC1-nSpCas9 (D10A)-MG69-1 in HEK293T
ggcccagactgagcacgtga

SEQ ID NO: 498 - DNA, 20 bp, synthetic construct
  source 1..20: mol_type = other DNA; note = rAPOBEC1-nSpCas9 (D10A)-MG69-2 in HEK293T
ggcccagactgagcacgtga

SEQ ID NO: 499 - DNA, 22 bp, synthetic construct
  source 1..22: mol_type = other DNA; note = A0A2K5RDN7-nMG1-4 (D9A)-MG69-1_site 1 in HEK293T
gattcccacctctcaatacgtt

SEQ ID NO: 500 - DNA, 22 bp, synthetic construct
  source 1..22: mol_type = other DNA; note = A0A2K5RDN7-nMG1-4 (D9A)-MG69-1_site 2 in HEK293T
cccaggcaggcaggctctccga

SEQ ID NO: 501 - DNA, 22 bp, synthetic construct
  source 1..22: mol_type = other DNA; note = A0A2K5RDN7-nMG1-4 (D9A)-MG69-1_site 3 in HEK293T
caccccctctccctccatcagt

SEQ ID NO: 502 - DNA, 22 bp, synthetic construct
  source 1..22: mol_type = other DNA; note = A0A2K5RDN7-nMG1-4 (D9A)-MG69-1_site 4 in HEK293T
tgtacacagtttcccaagctac

SEQ ID NO: 503 - DNA, 22 bp, synthetic construct
  source 1..22: mol_type = other DNA; note = A0A2K5RDN7-nMG3-6 (D13A)-MG69-1_site 1 in HEK293T
ctggactctggccactccctgg

SEQ ID NO: 504 - DNA, 22 bp, synthetic construct
  source 1..22: mol_type = other DNA; note = A0A2K5RDN7-nMG3-6 (D13A)-MG69-1_site 2 in HEK293T
catccagctccagccccagagc

SEQ ID NO: 505 - DNA, 22 bp, synthetic construct
  source 1..22: mol_type = other DNA; note = A0A2K5RDN7-nMG3-6 (D13A)-MG69-1_site 3 in HEK293T
gattccggctctgagggccagt

SEQ ID NO: 506 - DNA, 22 bp, synthetic construct
  source 1..22: mol_type = other DNA; note = A0A2K5RDN7-nMG3-6 (D13A)-MG69-1_site 4 in HEK293T
gcccttctgtttgtcccacttg

SEQ ID NO: 507 - DNA, 22 bp, synthetic construct
  source 1..22: mol_type = other DNA; note = A0A2K5RDN7-nMG3-6 (D13A)-MG69-1_site 5 in HEK293T
ttggccaagccaggcctagaat

SEQ ID NO: 508 - DNA, 22 bp, synthetic construct
  source 1..22: mol_type = other DNA; note = A0A2K5RDN7-nMG3-6 (D13A)-MG69-1_site 6 in HEK293T
ctcagctggtacacggcagggt

SEQ ID NO: 509 - DNA, 22 bp, synthetic construct
  source 1..22: mol_type = other DNA; note = A0A2K5RDN7-nMG3-6 (D13A)-MG69-1_site 7 in HEK293T
tcgcctatgggaactctggagg

SEQ ID NO: 510 - DNA, 22 bp, synthetic construct
  source 1..22: mol_type = other DNA; note = A0A2K5RDN7-nMG4-2 (D28A)-MG69-1_site 1 in HEK293T
cctaacatggataagtccagat

SEQ ID NO: 511 - DNA, 22 bp, synthetic construct
  source 1..22: mol_type = other DNA; note = A0A2K5RDN7-nMG4-2 (D28A)-MG69-1_site 2 in HEK293T
ggccctcagagccggaatctac

SEQ ID NO: 512 - DNA, 22 bp, synthetic construct
  source 1..22: mol_type = other DNA; note = A0A2K5RDN7-nMG4-2 (D28A)-MG69-1_site 3 in HEK293T
tgtcctccctcaagatacagga

SEQ ID NO: 513 - DNA, 22 bp, synthetic construct
  source 1..22: mol_type = other DNA; note = A0A2K5RDN7-nMG4-2 (D28A)-MG69-1_site 4 in HEK293T
tgtgttcacctgcccttctgtt

SEQ ID NO: 514 - DNA, 22 bp, synthetic construct
  source 1..22: mol_type = other DNA; note = A0A2K5RDN7-nMG18-1 (D12A)-MG69-1_site 1 in HEK293T
cagtgtcccccttccctatggg

SEQ ID NO: 515 - DNA, 22 bp, synthetic construct
  source 1..22: mol_type = other DNA; note = A0A2K5RDN7-nMG18-1 (D12A)-MG69-1_site 2 in HEK293T
cccccttccctatgggaataat

SEQ ID NO: 516 - DNA, 22 bp, synthetic construct
  source 1..22: mol_type = other DNA; note = A0A2K5RDN7-nMG18-1 (D12A)-MG69-1_site 3 in HEK293T
cagctccagccccagagcctgg

SEQ ID NO: 517 - DNA, 22 bp, synthetic construct
  source 1..22: mol_type = other DNA; note = A0A2K5RDN7-nMG18-1 (D12A)-MG69-1_site 4 in HEK293T
gtgcctctccctgcagacggta

SEQ ID NO: 518 - DNA, 20 bp, synthetic construct
  source 1..20: mol_type = other DNA; note = A0A2K5RDN7-nSpCas9 (D10A)-MG69-1_site 1 in HEK293T
ttgccacgaagcaggccaat

SEQ ID NO: 519 - DNA, 20 bp, synthetic construct
  source 1..20: mol_type = other DNA; note = A0A2K5RDN7-nSpCas9 (D10A)-MG69-1_site 2 in HEK293T
cccggggccgccattgacag

SEQ ID NO: 520 - DNA, 20 bp, synthetic construct
  source 1..20: mol_type = other DNA; note = A0A2K5RDN7-nSpCas9 (D10A)-MG69-1_site 3 in HEK293T
tccggctctgagggccagtg

SEQ ID NO: 521 - DNA, 20 bp, synthetic construct
  source 1..20: mol_type = other DNA; note = A0A2K5RDN7-nSpCas9 (D10A)-MG69-1_site 4 in HEK293T
caaccagtccccagtgactc

SEQ ID NO: 522 - DNA, 20 bp, synthetic construct
  source 1..20: mol_type = other DNA; note = A0A2K5RDN7-nSpCas9 (D10A)-MG69-1_site 5 in HEK293T
gagtccgagcagaagaagaa

SEQ ID NO: 523 - DNA, 21 bp, synthetic construct
  source 1..21: mol_type = other DNA; note = Forward primer used to amplify lacZ of E. coli and Sanger sequencing
ccaggctttacactttatgct

SEQ ID NO: 524 - DNA, 25 bp, synthetic construct
  source 1..25: mol_type = other DNA; note = Reverse primer used to amplify lacZ of E. coli and Sanger sequencing
cgaacatccaaaagtttgtgttttt

SEQ ID NO: 525 - DNA, 18 bp, synthetic construct
  source 1..18: mol_type = other DNA; note = Sanger sequencing of base edit of lacZ of E. coli
ccgaaaggcgcggtgccg

SEQ ID NO: 526 - DNA, 19 bp, synthetic construct
  source 1..19: mol_type = other DNA; note = Sanger sequencing of base edit of lacZ of E. coli
gtatgtggtggatgaagcc

SEQ ID NO: 527 - DNA, 18 bp, synthetic construct
  source 1..18: mol_type = other DNA; note = Sanger sequencing of base edit of lacZ of E. coli
ttgtggagcgacatccag

SEQ ID NO: 528 - DNA, 19 bp, synthetic construct
  source 1..19: mol_type = other DNA; note = Sanger sequencing of base edit of lacZ of E. coli
tgagcgcatttttacgcgc

SEQ ID NO: 529 - DNA, 18 bp, synthetic construct
  source 1..18: mol_type = other DNA; note = Sanger sequencing of base edit of lacZ of E. coli
gaaaacggcaacccgtgg

SEQ ID NO: 530 - DNA, 20 bp, synthetic construct
  source 1..20: mol_type = other DNA; note = Sanger sequencing of base edit of lacZ of E. coli
ggattgaaaatggtctgctg

SEQ ID NO: 531 - DNA, 18 bp, synthetic construct
  source 1..18: mol_type = other DNA; note = Sanger sequencing of base edit of lacZ of E. coli
actgctgacgccgctgcg

SEQ ID NO: 532 - DNA, 48 bp, synthetic construct
  source 1..48: mol_type = other DNA; note = Forward primer used to amplify CAT (H193Y) of CAT (H193Y)-sgRNA- MG68-4 variant-nSpCas9 (D10A)
ccgccgccgcaaggaatggtttaattaatttgatcggcacgtaagagg

SEQ ID NO: 533 - DNA, 50 bp, synthetic construct
  source 1..50: mol_type = other DNA; note = Reverse primer used to amplify CAT (H193Y) of CAT (H193Y)-sgRNA-MG68-4 variant-nSpCas9
ggactgttgggcgccatctccttgcatgcttcacttattcaggcgtagca

SEQ ID NO: 534 - DNA, 50 bp, synthetic construct
  source 1..50: mol_type = other DNA; note = Forward primer used to amplify CAT (H193Y) of CAT (H193Y)-sgRNA-MG68-4 variant-nMG34-1 (D10A)
aaggaatggtttaattaattctagattaattaatttgatcggcacgtaag

SEQ ID NO: 535 - DNA, 50 bp, synthetic construct; identical to SEQ ID NO: 533
  source 1..50: mol_type = other DNA; note = Sanger sequencing primer of CAT (H193Y)

SEQ ID NO: 536 - DNA, 18 bp, synthetic construct
  source 1..18: mol_type = other DNA; note = Forward primer used to amplify BE3 target site in HEK293T cells and Sanger sequencing
gaggctggagaggcccgt

SEQ ID NO: 537 - DNA, 22 bp, synthetic construct
  source 1..22: mol_type = other DNA; note = Reverse primer used to amplify BE3 target site in HEK293T cells for Sanger sequencing
gattttcatgcaggtgctgaaa

SEQ ID NO: 538 - DNA, 36 bp, synthetic construct
  source 1..36: mol_type = other DNA; note = Forward primer used to amplify A0A2K5RDN7-nSpCas9 (D10A)-MG69-1_site 1 in HEK293T cells
gctcttccgatctnnnnnaggaggaagggcctgagt

SEQ ID NO: 539 - DNA, 36 bp, synthetic construct
  source 1..36: mol_type = other DNA; note = Reverse primer used to amplify A0A2K5RDN7-nSpCas9 (D10A)-MG69-1_site 1 in HEK293T cells
gctcttccgatctnnnnntctgccctcgtgggtttg

SEQ ID NO: 540 - DNA, 36 bp, synthetic construct
  source 1..36: mol_type = other DNA; note = Forward primer used to amplify A0A2K5RDN7-nSpCas9 (D10A)-MG69-1_site 2 in HEK293T cells
gctcttccgatctnnnnnctctggccactccctggc

SEQ ID NO: 541 - DNA, 36 bp, synthetic construct
  source 1..36: mol_type = other DNA; note = Reverse primer used to amplify A0A2K5RDN7-nSpCas9 (D10A)-MG69-1_site 2 in HEK293T cells
gctcttccgatctnnnnnggcaggctctccgaggag

SEQ ID NO: 542 - DNA, 44 bp, synthetic construct
  source 1..44: mol_type = other DNA; note = Forward primer used to amplify A0A2K5RDN7-nSpCas9 (D10A)-MG69-1_site 3 in HEK293T cells
gctcttccgatctnnnnngggaataataaaagtctctctcttaa

SEQ ID NO: 543 - DNA, 36 bp, synthetic construct
  source 1..36: mol_type = other DNA; note = Reverse primer used to amplify A0A2K5RDN7-nSpCas9 (D10A)-MG69-1_site 3 in HEK293T cells
gctcttccgatctnnnnnccccctccaccagtaccc

SEQ ID NO: 544 - DNA, 36 bp, synthetic construct
  source 1..36: mol_type = other DNA; note = Forward primer used to amplify A0A2K5RDN7-nSpCas9 (D10A)-MG69-1_site 4 in HEK293T cells
gctcttccgatctnnnnncctgtccttggagaaccg

SEQ ID NO: 545 - DNA, 37 bp, synthetic construct
  source 1..37: mol_type = other DNA; note = Reverse primer used to amplify A0A2K5RDN7-nSpCas9 (D10A)-MG69-1_site 4 in HEK293T cells
gctcttccgatctnnnnngcaggtgaacacaagagct

SEQ ID NO: 546 - DNA, 37 bp, synthetic construct
  source 1..37: mol_type = other DNA; note = Forward primer used to amplify A0A2K5RDN7-nSpCas9 (D10A)-MG69-1_site 5 in HEK293T cells
gctcttccgatctnnnnngaaggtgtggttccagaac

SEQ ID NO: 547 - DNA, 36 bp, synthetic construct
  source 1..36: mol_type = other DNA; note = Reverse primer used to amplify A0A2K5RDN7-nSpCas9 (D10A)-MG69-1_site 5 in HEK293T cells
gctcttccgatctnnnnntcgatgtcctccccattg

SEQ ID NO: 548 - DNA, 38 bp, synthetic construct
  source 1..38: mol_type = other DNA; note = Forward primer used to amplify A0A2K5RDN7-nMG1-4 (D9A)-MG69-1_site 1 in HEK293T cells
gctcttccgatctnnnnnaaacaggctagacataggga

SEQ ID NO: 549 - DNA, 37 bp, synthetic construct
  source 1..37: mol_type = other DNA; note = Reverse primer used to amplify A0A2K5RDN7-nMG1-4 (D9A)-MG69-1_site 1 in HEK293T cells
gctcttccgatctnnnnngaagccaccagagtctcta

SEQ ID NO: 550 - DNA, 36 bp, synthetic construct
  source 1..36: mol_type = other DNA; note = Forward primer used to amplify A0A2K5RDN7-nMG1-4 (D9A)-MG69-1_site 2 in HEK293T cells
gctcttccgatctnnnnngccgccattgacagaggg

SEQ ID NO: 551 - DNA, 41 bp, synthetic construct
  source 1..41: mol_type = other DNA; note = Reverse primer used to amplify A0A2K5RDN7-nMG1-4 (D9A)-MG69-1_site 2 in HEK293T cells
gctcttccgatctnnnnngcatcaaaacaaaagggagattg

SEQ ID NO: 552 - DNA, 36 bp, synthetic construct
  source 1..36: mol_type = other DNA; note = Forward primer used to amplify A0A2K5RDN7-nMG1-4 (D9A)-MG69-1_site 3 in HEK293T cells
gctcttccgatctnnnnncctctgcccacctcactt

SEQ ID NO: 553 - DNA, 37 bp, synthetic construct
  source 1..37: mol_type = other DNA; note = Reverse primer used to amplify A0A2K5RDN7-nMG1-4 (D9A)-MG69-1_site 3 in HEK293T cells
gctcttccgatctnnnnngccatgtgggttaatctgg

SEQ ID NO: 554 - DNA, 36 bp, synthetic construct
  source 1..36: mol_type = other DNA; note = Forward primer used to amplify A0A2K5RDN7-nMG1-4 (D9A)-MG69-1_site 4 in HEK293T cells
gctcttccgatctnnnnnccggacgcacctacccat

SEQ ID NO: 555 - DNA, 37 bp, synthetic construct
  source 1..37: mol_type = other DNA; note = Reverse primer used to amplify A0A2K5RDN7-nMG1-4 (D9A)-MG69-1_site 4 in HEK293T cells
gctcttccgatctnnnnnctagatgggaatggatggg

SEQ ID NO: 556 - DNA, 36 bp, synthetic construct
  source 1..36: mol_type = other DNA; note = Forward primer used to amplify A0A2K5RDN7-nMG3-6 (D13A)-MG69-1_site 1 in HEK293T cells
gctcttccgatctnnnnnaaccacaaacccacgagg

SEQ ID NO: 557 - DNA, 36 bp, synthetic construct
  source 1..36: mol_type = other DNA; note = Reverse primer used to amplify A0A2K5RDN7-nMG3-6 (D13A)-MG69-1_site 1 in HEK293T cells
gctcttccgatctnnnnntcaatggcggccccgggc

SEQ ID NO: 558 - DNA, 36 bp, synthetic construct
  source 1..36: mol_type = other DNA; note = Forward primer used to amplify A0A2K5RDN7-nMG3-6 (D13A)-MG69-1_site 2 in HEK293T cells
gctcttccgatctnnnnnagtgatccccagtgtccc

SEQ ID NO: 559 - DNA, 36 bp, synthetic construct
  source 1..36: mol_type = other DNA; note = Reverse primer used to amplify A0A2K5RDN7-nMG3-6 (D13A)-MG69-1_site 2 in HEK293T cells
gctcttccgatctnnnnngccctgaacgcgtttgct

SEQ ID NO: 560 - DNA, 42 bp, synthetic construct
  source 1..42: mol_type = other DNA; note = Forward primer used to amplify A0A2K5RDN7-nMG3-6 (D13A)-MG69-1_site 3 in HEK293T cells
gctcttccgatctnnnnntgggaataataaaagtctctctct

SEQ ID NO: 561 - DNA, 36 bp, synthetic construct
  source 1..36: mol_type = other DNA; note = Reverse primer used to amplify A0A2K5RDN7-nMG3-6 (D13A)-MG69-1_site 3 in HEK293T cells
gctcttccgatctnnnnncccctccaccagtacccc

SEQ ID NO: 562 - DNA, 36 bp, synthetic construct
  source 1..36: mol_type = other DNA; note = Forward primer used to amplify A0A2K5RDN7-nMG3-6 (D13A)-MG69-1_site 4 in HEK293T cells
gctcttccgatctnnnnncagggcctcctcagccca

SEQ ID NO: 563 - DNA, 38 bp, synthetic construct
  source 1..38: mol_type = other DNA; note = Reverse primer used to amplify A0A2K5RDN7-nMG3-6 (D13A)-MG69-1_site 4 in HEK293T cells
gctcttccgatctnnnnngtctggatgtcgtaagggaa

SEQ ID NO: 564 - DNA, 40 bp, synthetic construct
  source 1..40: mol_type = other DNA; note = Forward primer used to amplify A0A2K5RDN7-nMG3-6 (D13A)-MG69-1_site 5 in HEK293T cells
gctcttccgatctnnnnnggggtgtaactcagaatgtttt

SEQ ID NO: 565 - DNA, 36 bp, synthetic construct
  source 1..36: mol_type = other DNA; note = Reverse primer used to amplify A0A2K5RDN7-nMG3-6 (D13A)-MG69-1_site 5 in HEK293T cells
gctcttccgatctnnnnngggagtgagactcagaga

SEQ ID NO: 566 - DNA, 39 bp, synthetic construct
  source 1..39: mol_type = other DNA; note = Forward primer used to amplify A0A2K5RDN7-nMG3-6 (D13A)-MG69-1_site 6 in HEK293T cells
gctcttccgatctnnnnngcaaagagggaaatgagatca

SEQ ID NO: 567 - DNA, 41 bp, synthetic construct
  source 1..41: mol_type = other DNA; note = Reverse primer used to amplify A0A2K5RDN7-nMG3-6 (D13A)-MG69-1_site 6 in HEK293T cells
gctcttccgatctnnnnngtgacacatttgtttgagaatca

SEQ ID NO: 568 - DNA, 36 bp, synthetic construct
  source 1..36: mol_type = other DNA; note = Forward primer used to amplify A0A2K5RDN7-nMG3-6 (D13A)-MG69-1_site 7 in HEK293T cells
gctcttccgatctnnnnnctttatccccgcacagag

SEQ ID NO: 569 - DNA, 36 bp, synthetic construct
  source 1..36: mol_type = other DNA; note = Reverse primer used to amplify A0A2K5RDN7-nMG3-6 (D13A)-MG69-1_site 7 in HEK293T cells
gctcttccgatctnnnnncttggcccatgggaaatc

SEQ ID NO: 570 - DNA, 36 bp, synthetic construct
  source 1..36: mol_type = other DNA; note = Forward primer used to amplify A0A2K5RDN7-nMG4-2 (D28A)-MG69-1_site 1 in HEK293T cells
gctcttccgatctnnnnngtcccatcccaacacccc

SEQ ID NO: 571 - DNA, 36 bp, synthetic construct
  source 1..36: mol_type = other DNA; note = Reverse primer used to amplify A0A2K5RDN7-nMG4-2 (D28A)-MG69-1_site 1 in HEK293T cells
gctcttccgatctnnnnntgggcatgtgtgctccca

SEQ ID NO: 572 - DNA, 42 bp, synthetic construct
  source 1..42: mol_type = other DNA; note = Forward primer used to amplify A0A2K5RDN7-nMG4-2 (D28A)-MG69-1_site 2 in HEK293T cells
gctcttccgatctnnnnnctatgggaataataaaagtctctc

SEQ ID NO: 573 - DNA, 36 bp, synthetic construct
  source 1..36: mol_type = other DNA; note = Reverse primer used to amplify A0A2K5RDN7-nMG4-2 (D28A)-MG69-1_site 2 in HEK293T cells
gctcttccgatctnnnnnctccaccagtaccccacc

SEQ ID NO: 574 - DNA, 36 bp, synthetic construct
  source 1..36: mol_type = other DNA; note = Forward primer used to amplify A0A2K5RDN7-nMG4-2 (D28A)-MG69-1_site 3 in HEK293T cells
gctcttccgatctnnnnnggaccctggtctctacct

SEQ ID NO: 575 - DNA, 37 bp, synthetic construct
  source 1..37: mol_type = other DNA; note = Reverse primer used to amplify A0A2K5RDN7-nMG4-2 (D28A)-MG69-1_site 3 in HEK293T cells
gctcttccgatctnnnnncctctcccattgaactacc

SEQ ID NO: 576 - DNA, 36 bp, synthetic construct
  source 1..36: mol_type = other DNA; note = Forward primer used to amplify A0A2K5RDN7-nMG4-2 (D28A)-MG69-1_site 4 in HEK293T cells
gctcttccgatctnnnnnccccagtgactcagggcc

SEQ ID NO: 577 - DNA, 40 bp, synthetic construct
  source 1..40: mol_type = other DNA; note = Reverse primer used to amplify A0A2K5RDN7-nMG4-2 (D28A)-MG69-1_site 4 in HEK293T cells
gctcttccgatctnnnnntcgtaagggaaagacttaggaa

SEQ ID NO: 578 - DNA, 42 bp, synthetic construct
  source 1..42: mol_type = other DNA; note = Forward primer used to amplify A0A2K5RDN7-nMG18-1 (D12A)-MG69-1_site 1 in HEK293T cells
gctcttccgatctnnnnntctcccttttgttttgatgcattt

SEQ ID NO: 579 - DNA, 36 bp, synthetic construct
  source 1..36: mol_type = other DNA; note = Reverse primer used to amplify A0A2K5RDN7-nMG18-1 (D12A)-MG69-1_site 1 in HEK293T cells
gctcttccgatctnnnnnccaccccaggctctgggg

SEQ ID NO: 580 - DNA, 44 bp, synthetic construct
  source 1..44: mol_type = other DNA; note = Forward primer used to amplify A0A2K5RDN7-nMG18-1 (D12A)-MG69-1_site 2 in HEK293T cells
gctcttccgatctnnnnnccttttgttttgatgcatttctgttt

SEQ ID NO: 581 - DNA, 36 bp, synthetic construct
  source 1..36: mol_type = other DNA; note = Reverse primer used to amplify A0A2K5RDN7-nMG18-1 (D12A)-MG69-1_site 2 in HEK293T cells
gctcttccgatctnnnnnaatctaccaccccaggct

SEQ ID NO: 582 - DNA, 36 bp, synthetic construct
  source 1..36: mol_type = other DNA; note = Forward primer used to amplify A0A2K5RDN7-nMG18-1 (D12A)-MG69-1_site 3 in HEK293T cells
gctcttccgatctnnnnnatccccagtgtccccctt

SEQ ID NO: 583 - DNA, 36 bp, synthetic construct
  source 1..36: mol_type = other DNA; note = Reverse primer used to amplify A0A2K5RDN7-nMG18-1 (D12A)-MG69-1_site 3 in HEK293T cells
gctcttccgatctnnnnnccaggccctgaacgcgtt

SEQ ID NO: 584 - DNA, 36 bp, synthetic construct
  source 1..36: mol_type = other DNA; note = Forward primer used to amplify A0A2K5RDN7-nMG18-1 (D12A)-MG69-1_site 4 in HEK293T cells
gctcttccgatctnnnnnaggccaggcctgcggggg

SEQ ID NO: 585 - DNA, 41 bp, synthetic construct
  source 1..41: mol_type = other DNA; note = Reverse primer used to amplify A0A2K5RDN7-nMG18-1 (D12A)-MG69-1_site 4 in HEK293T cells
gctcttccgatctnnnnnccaaaaactcccaaattagcaaa

SEQ ID NO: 586 - protein, 969 aa, synthetic construct
  source 1..969: note = TadA (ABE8.17m)-nMG34-1 (D10A)
MGSSHHHHHHSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEGSGGSPKKKRKV

SEQ ID NO: 587 - protein, 1104 aa, synthetic construct
  source 1..1104: note = rAPOBEC1-nMG34-1 (D10A)-UGI (PBS1)
MGSSHHHHHHMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESAMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 588 - protein, 1592 aa, synthetic construct
  source 1..1592: note = MG68-3-nSpCas9 (D10A)
MGSSHHHHHHMNEQTSTDEQFMQQALALADEAERQGEVPVGALLVHQGTVIGRGFNQVITQLDPSAHAEMLAIRDAARYLQNYRILDTTLYVTLEPCPMCAGALVHARVKRLVYGASDPRTGACGSVFNVVADTRLNHQLEVVAGVLGSQCGERLSAFFRQRRAAQKALKKAAQNFQSPSSGGSSGGSSGSETPGTSESATPESSGGSSGGSMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGGSPKKKRKV

SEQ ID NO: 589 - protein, 1588 aa, synthetic construct
  source 1..1588: note = MG68-8-nSpCas9 (D10A)
MGSSHHHHHHMPQSEQDIYWIRYAMQLAERAEQAGEVPVGAVLVLDNQALGEGWNLSISRHDPCAHAEIMAIRQAGERIGNYRLLGATLYVTLEPCVMCAGAMVHSRIARVVYGASDLKTGAAGSVFDVLSDPRHNHVVEITGGVESEACSQQLSDFFRRRRAEQKAEKQRLKDNQSGGSSGGSSGSETPGTSESATPESSGGSSGGSMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGGSPKKKRKV

SEQ ID NO: 590 - protein, 16 aa, synthetic construct
  source 1..16: note = peptide sequences of linkers suitable for the engineered nucleic acid
SGSETPGTSESATPES

SEQ ID NO: 591 - protein, 17 aa, synthetic construct
  source 1..17: note = peptide sequences of linkers suitable for the engineered nucleic acid
SGSETPGTSESATPESA

SEQ ID NO: 592 - protein, 32 aa, synthetic construct
  source 1..32: note = peptide sequences of linkers suitable for the engineered nucleic acid
SGGSSGGSSGSETPGTSESATPESSGGSSGGS

SEQ ID NO: 593 - protein, 34 aa, synthetic construct
  source 1..34: note = peptide sequences of linkers suitable for the engineered nucleic acid
GTSGGSSGGSSGSETPGTSESATPESSGGSSGGS

SEQ ID NO: 594 - protein, 206 aa, Cebus imitator
  source 1..206: note = CMP/dCMP-type deaminase domain-containing protein (uniprot accession A0A2K5RDN7)
MEASPASRPRPLMGPRTFTENFTNNPEVFGRHQTYLCYEVKCQGPDGTRDLMTEQRDFLCNQARNLLSGFDGRHAERCFLDRVPSWRLDPAQTYRVTCFISWSPCFSCAREVAEFLQENPHVNLRIFAARIYDCRPRYEEGLQMLQNAGAQVSIMTSEEFRHCWDTFVDHQGHPFQPWEGLDEHSQALSRRLQAILQGNRWMILSL

SEQ ID NO: 595 - protein, 167 aa, unidentified
  source 1..167: note = TadA* (ABE8.17m)
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTD

SEQ ID NO: 596 - protein, 747 aa, unidentified
  source 1..747: note = MG34-1 effector
MERELVLGIDYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAE

SEQ ID NO: 597 - protein, 747 aa, unidentified
  source 1..747: note = MG34-1 (D10A)
MERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAE

SEQ ID NO: 598 - skipped

SEQ ID NO: 599 - protein, 197 aa, unidentified
  source 1..197: note = MG138-1
MAAVTDRDLAPRENNQRWKIRPNDFKRNYLPGQHPKVVYLLYEIRWSRGTIWRNWCSNNSTQHAEVNFLENCFKAMPSVSCSITWVLSTTPCGKCSRRILEFLRVHPNVTLEIYAAKLFKHLDIRNRQGLRNLAMNGVIIRIMNLADYSYGWKRFVAYQRGEDDYWPWSFASYILLNWIELYHILSGLPPLLANFKY

SEQ ID NO: 600 - protein, 194 aa, unidentified
  source 1..194: note = MG138-2
MAAVADRDAAPRENIQGWKLQPNDFKRNYLPGQHPKVVYLLYEIRWSRGTIWRNWCSNNSTQHAEVNFLENCFKATPSVSCSITWVLSTTPCGKCSRRILEFLRVHPNVTLEIYAAKLFKHLDIRNRKGLRDLAMNGVIIRIMNLSDYSYCWKTFVAYQHGKEDYWPWSFASYIFLNQAELSHILLGLPPLLAN

SEQ ID NO: 601 - protein, 203 aa, unidentified
  source 1..203: note = MG138-3
MAAVTDRDPAPRRNNQGWKIQPNDFKRNYLPDHHPEVVYLLYEIRWRRGTIWRNWCSNNSSQHAEVNFLENCFKATPSVSCSITWVLSTTPCGKCSKRILDFLRVHPNVTLEIYAAKLFKHLDIRNRQGLRNLALTGVAIRIMNLADYSYCWKTFVAHEHGQGDYWPLSFASYIFLNSTELSHILLVSRHLNKMLRVKSNAKS

SEQ ID NO: 602 - protein, 192 aa, unidentified
  source 1..192: note = MG138-4
MAAVPDRGPAARENNQRWKILPDDFIRNYFPDQHPNAVYVLYEIRWSRGTIWRSWCSNSFDQHAEVNFLENYFKARPSASCSITWFLSTTPCGRCSRRILEFLRAHPNVTLEIYAAKLFKHLDIRNRQGLKNLAMNGVIIRIMDLPDYSYCWKTFVAYQRAEDIYWSWRFKSYIFLNCMELYRILLGLPPLL

SEQ ID NO: 603 - protein, 196 aa, unidentified
  source 1..196: note = MG138-5
MAAVSNRGRAPRQNNQRWKMQPDDFKSNYLPSQHPKVVYLMYAIKWRRGTIWRGWCSNNPTQHAEVNFLENCFKPLSSASCSITWVLSTTPCGKCSKRILEFLRIHPNVTLKIFAAKIFKHLDIRNRQGLRNLTEKGVIIRIMSPADYSSSWKRFVAYQHGEEDYWPWNFILHILLNCIELHRIILGLPPVLNLEY

SEQ ID NO: 604 - protein, 196 aa, unidentified
  source 1..196: note = MG138-6
MAADIGRGRALTQNNQRWKIQPDDFKSNYLPSQHPKVVCLLYAIKWRRGKVWKGWCTNNSTQHAEVNFLENCFKPLSSASCSITWVLSTTPCGKCSRRILEFLRIHPNVTLEIFAAKIFKHLDIRNRQGLRNLMMKGVIIRIMRPADYSYSWKKFVAYQHGEEDYWPWSFSLYILLNCIELKRIILGLPPVSNFEY

SEQ ID NO: 605 - protein, 178 aa, unidentified
  source 1..178: note = MG138-7
MWKIQPGDFQRNYSPSQKAQVVYLLYEIRWRRRSVWRNWCSNNPGQHAEINFLENHFNDRRQAPCSITWFLSTSPCGNCSRRILEFLRSHPNVTLKIYAARLFKHHDAHNRHGLHSLMMNGVAVHIMNPEDYSYCWRNFVEYQPGEDHYQPQNVILYFFLNFTELFHIFLGFPPLLPN

SEQ ID NO: 606 - protein, 193 aa, unidentified
  source 1..193: note = MG138-8
MAAVSARGPSSRENNQGWKMQPEDFQRNYSPRQNGRVYLLYEIRWRSSSIWRNWCSNNPEQHAEVNFLENHFNNQPQTPCCITWFLSASPCGNCCRRILKFLRSHPNVTLVICAAKLFRHLDIRNRRGLRSLMMNGVAIRIMNLEDYRYCWRNFVAHQPGQDDYWPQNVTLYFILNSIELLHIFLDLPPFLAN

SEQ ID NO: 607 - protein, 184 aa, unidentified
  source 1..184: note = MG138-9
MYRRRMRGMHISKRALRKHFDPREYPKETYLLCKLEWRGGIRSWKHWVRNDDVNDCHAEQYFLEEIFEPRCYNICDMTWYLSYSPCWKCCDVIRDFLEEQTNVNIYIHVARLYYVNHPNNCRALRELNSLENVTIEAMEAEDYDYCRDTFIQRGVHCDFSPTRFQSEIQRNRVKLEDILQDLHL

SEQ ID NO: 608 - protein, 193 aa, unidentified
  source 1..193: note = MG138-10
MYISKRALRKHFDPREYPKETYLLCELKWRGGVRSWQHWVRNDDYNDCHAEQYFLEEIFEPRYYNICDMTWYLSYSPCWECCDVIRDFLEEQTNVNICIHVARLYYVNYPINCQALRELNRLEKVTIKAMEAEGKVSHALWGWGGVNYLASISPDYDYCRETFIQRDVHCDFSPKRFQSEIQRNRVKLEDILQ

SEQ ID NO: 609 - protein, 183 aa, unidentified
  source 1..183: note = MG138-11
MYRRKTRGMYISKRALRKHFDPREYPRETYLLCELKWRGGARSWKHWVRNEDDNYHAEQYFLEEIFEPRSYNTCDMTWYLSYSPCWKCCQVIEGFLEEQRNVNIDIRVARLYYVKDPRNCMALRELRRFQGVRITAMEAEDYDYCWDTFIQPDVNYDFSPKKFKSEIQRNRVKLEDIFQGLHL

SEQ ID NO: 610 - protein, 185 aa, unidentified
  source 1..185: note = MG138-12
MYRKKMRGMYISKKALKTQFDPFKFPRETYLLCKLRWGESDRSWIHWVKNYPGDYYHAEVYFLEKIFRMKPYNNVKCSITWYLSWSPCVNCCCEIVYFLERHENVNIDIHVARLYFKDSERTRRGLKKLARSAQVNISVMNMEDYKDCSKNFIQGGADDFWTVNFESEITKNCLKLWDILEDLHL

SEQ ID NO: 611 - protein, 197 aa, unidentified
  source 1..197: note = MG138-13
MYKKKLKGMYVSKKALKNHFDPRNTPRDTYLLCKLQWGETGTPWIHWVRKDRYHAEVYFLEKIFKMKRSNNYVNCSITWYLSWSPCADCCHKILKFLKKHSNVNIDIHVARVYYAEDEKVRQGLKNLVSLAKVTIAVMETKDYTDCWKNFIQGGADGGFQTVDFQLAVEVNRLKLKNIFEDLPLIEYLSLEGTHEDH

SEQ ID NO: 612 - protein, 217 aa, unidentified
  source 1..217: note = MG138-14
MYKKKLRGRATENKVVTSHSLKFLFCFSMYISKKALKNHFDPRNTPRDTYLLCKLQWGETGTPWIHWVRNDHYHAEVYFLEKVFKMKRSNNYVNCSITWYLSWSPCADCCHEILKFLKKHSNVNIDIYVARVYYADDEDSRQGLKNLVSLAEVTIAVMEMQDYTDCWKNFIQGGTDGGFWTEGFQSAVKKNRLKLKNMFEDLPLIEYLSLEGTHEDH

SEQ ID NO: 613 - protein, 204 aa, unidentified
  source 1..204: note = MG138-15
MYVSKNVLKYHFDPYETPQDTYLLCKLQWGETGTPWIHWVKNDRYHAEVYFLKKIFKMRRSNNYVNCSVTWYLSWSPCVNCCRKILNFLKKHSNVNIDMHVARLYYIEDERIRQGLKNLVSLAKVTIAVMEIEDYTYCWKNFIQGDVDDDAWTVGFQPKINKNRLKLKDVLEEEEICTRITLSQMENPALALLKFHTVDDCPAL

SEQ ID NO: 614 - protein, 172 aa, unidentified
  source 1..172: note = MG138-16
MYISMKALKYNFDPRETPQDTYLLCKLQWGETGTPWIHWVKNDHCHAEVYFLEKIFKTRRSNNYVKCSITWYLSWSPCADCCRTILNFLKKHSYVYIDIHVARLYYIEDEKIQQGLKKLVSLAAVTITVMEIEDYIYCWKNFLQRDIDDDYWTVGFQPKITKNYLKLKDVIE

SEQ ID NO: 615 - protein, 179 aa, unidentified
  source 1..179: note = MG138-17
MRKETGMYISKAALKHNFNPHETPKDTYLLCKLQWGETGTPWIHWVRNERYHHAESYFLEKIFKMRRSSNYVKCNITWYLSWSPCADCCHKILNFLKRHSNVNIDIYVARLYYIEDEEIRQCLKNLVSLAEVTIAVMKIEDYIYCQKKFIQGGDDDDSWTVSFQPEISKNRLKLKDVFE

SEQ ID NO: 616 - protein, 178 aa, unidentified
  source 1..178: note = MG138-18
MYISKKALTEQFDPRNSPRETYLLCKLQWGETGIPWTHWVRNDRDNKVHAEVYFLKNIFQRRRSNNYVNCSITWYLSWSPCVNCCYKIRDFLNRHSYVTIRIYVARLCYRGFHRNRKGLRNLVSLREVTVNVMEIKDYEDCWKVFIQGDGYDDSWTVGFQPEIIKNRMKLSNIKENLY

SEQ ID NO: 617 - protein, 195 aa, unidentified
  source 1..195: note = MG138-19
MEKRSAGGLAGRGEARRKKKLRGMYISKKALKHHFDPYEGLKETYLLCELKWGKAKKSWKHWVRNDHDHAEVIFLEKIFNVRRFNSRDTCSITWYLSWSPCARCCYKILDFLKEHSYVNLHIYVARLYCIEDEKTRRGLKKLNSLEGVTIAVMEEEEYTYCRKTFIQGDVGDDFWTRDFEPKITENRLKLKEVLK

SEQ ID NO: 618 - protein, 183 aa, unidentified
  source 1..183: note = MG138-20
MYKKKLRGMYMSKKAFKYHFDPRESPRATYLLCVIQWGCNGLPWIHWVKNGRSHAERYFLQKVFKMRRSNNNINCSITLYLSWSPCRNCCYEMQYFLKKHPNVNICIYLARLYYTEDEEICKALKDLSEKKVIISVMKIEDYIYCWKTFVSGNAAAGSWFKDFESQINKNHFQLKRILEVSPL

SEQ ID NO: 619 - protein, 182 aa, unidentified
  source 1..182: note = MG138-21
MPRRGFRGMYISKWALREHFDPRKYPRETYLLCELEWGRSSNFWQHWVRNDNDYHAEEYFLENIFEPRNNNFCNITWYLSYSPCPGCCQVIQDFLETHHNVNIDIRVARLYYADTASNRQGLRELHSSQGVTIDVMEEQDYKYCWETFIAGDVSYDFTPVDYQLEIWRNHLRLRTILTGRHY

SEQ ID NO: 620 - protein, 224 aa, unidentified
  source 1..224: note = MG138-22
MCLGTETETNVRLIKRHPSLKRQQTNPEISMAAVADRGAAPRENIQGWKLQPNDFKRNYLPGQHPKVVYMLYEIRWSRGTIWRNWCSNNSTQHAEVNFLENCFKATPSVSCSITWVLSTTPCGKCSRRILEFLRVYSNVTLEIYAAKLFKHLDIRNRQGLRDLAMNGVIIRIMNLSDYSYCWKRFVAYQHGEEDYWPWSFTSYIFLNQTELSHILLGLPPLLAN

SEQ ID NO: 621 - protein, 193 aa, unidentified; identical to SEQ ID NO: 606
  source 1..193: note = MG138-23

SEQ ID NO: 622 - protein, 192 aa, unidentified; identical to SEQ ID NO: 602
  source 1..192: note = MG138-24

SEQ ID NO: 623 - protein, 203 aa, unidentified
  source 1..203: note = MG138-25
MAAVADRGAAPRENIQGWKLQPNDFKRNYLPGQHPKVVYMLYEIRWSRGTIWRNWCSNNSTQHAEVNFLENCFKATPSVSCSITWVLSTTPCGKCSRRILEFLRVYSNVTLEIYAAKLFKHLDIRNRQGLRDLAMNGVIIRIMNLSDYSYCWKRFVAYQHGEEDYWPWSFTSYIFLNQTELSHILLVSRHLKKTLREKSSAKS

SEQ ID NO: 624 - protein, 375 aa, unidentified
  source 1..375: note = MG138-26
MYRKKMRGMYISKKALKNQFDPSKFPRETYLLCKLRWGESESSWIHWVKNYRYDYYHAEVYFLEKIFRMKPYNNVNCSITWYLSWSPCVNCCNEILDFLERHENVNIDIHVARLYFKDSERTRRGLKKLARLAQVNINVMDMEDYKDCSKTFIQGGAPDDFWTVNFESEITENCLKLWDILEVTHKTRNIHGCGQWQRWKIKPKDFKRNYLPDRHSRVVYLLYEIRWRNGSIWRNWFSNNRSQHAEVNFLENCFSDVPPAPCSITWFLSTSPCGKCSERILEFLRTHRNVTLEIYTAKLFRHLDMRNRQGLCNLVMNGVAIRIMNLPDYRYCWKRFVAYQHGEDDYWPQNFAAYIFLNWRELGHIFLGLPPLLPY

SEQ ID NO: 625 - protein, 177 aa, unidentified
  source 1..177: note = MG138-27
MQPDDFKSNYLPSQHPKVVCLLYAIKWRRGTIWRGWCTNNSTQHAEVNFLENCFKPLSSVSCSITWVLSTTPCGKCSKRILEFLRIHPNVTLEIFAAKIFKHLDIRNRQGLRNLMMKGVIIRIMRPADYSYSWKKFVAYQHGEEDYCPWSFSLYILLNCIELERIILGLPPLSNFEY

SEQ ID NO: 626 - protein, 190 aa, unidentified
  source 1..190: note = MG138-28
MAAVTDRDPAPSRNNQGWKIQPNDFKRNYLPDHHPEVVYLLYEIKWRRGTIWRNWCSNNSSQHAEVNFLENCFKATPSVSCSITWVLSTTPCGKCSKRILDFLRVHPNVTLEIYAAKLFKHLDIRNRQGLRNLARTGVTIRIMNLADYSYCWKTFVAHEHGQGDYRPLSFASYIFLNSTELSHILWVAVY

SEQ ID NO: 627 - protein, 196 aa, unidentified; identical to SEQ ID NO: 603
  source 1..196: note = MG138-29

SEQ ID NO: 628 - protein, 333 aa, unidentified
  source 1..333: note = MG138-30
MYISRRALGYHFDPRVSPRDTFLLCRLQWGARGRRWKHWVRKDRHHAEVYFLEKIFEPRRFNNAHCSITWYLSWSPCANCCYRIVQFLMKHSYVSIDIRVARLYFIEDETTRQGLEELVSCARVRLTVMDTEGKVPFVLWNWEGVNWWKIEPDEFKTNYSPDHRPRVVYLLYEIRWRRGTIWRNWCSNNIDQHAEVNFLENCFKAKPSVSCSITWFLSTAPCAKCSRRILKFLTAHPKVTLEIYAAKLFRHLEIRNRQGLMDLAVNGVILRIMNLADYSYCWKQFVAYQRGQEVYWPQSFSPYIFLNWRELHHILLVSRYLKRTLPVKSNGRS

SEQ ID NO: 629 - protein, 196 aa, unidentified
  source 1..196: note = MG138-31
MAAVSNRGRAPRQNNQRWKMQPDDFKSNYLPSQHPKVVYLLYEIKWCRGTVWRGWCSNNSTQHAEVNFLENCFKPLSSVSCSITWVLSTTPCGKCSKRILEFLRIHPNVTLEIFAAKIFKHLDNRNRQGLRNLMMKGVIIRIMCPADYSYSWKRFVAYQHGEEDYWPRSFSLYILLNCIELERIIWGLPPLSNFEY

SEQ ID NO: 630 - protein, 374 aa, unidentified
  source 1..374: note = MG138-32
MYRRKMRGMYISKRALRIHFDPCKFPKETYLLCELQWRGSTKFWQHWVRNDHDYEDCHAEQYFLDEVFEPRSYNICDMTWYLSWSPCRECCDIIRDFLEEQPNVNIDIRVARLYYTNIPRYRDGLRELHSLEGVTIKAMEAEDYNYCWETFIQPGVNYYFSPNNFKSEIQRNRTKLEDILQGLHLYARITVLLVLFFRWKMQPRDFQRNYSPRQNGRVYLLYEIRWRRGSIWRNWCSNNHEQHAEVNFLENHFSVRPQTPCSITWFLSTSPCGKCSRRILEFLRSHPNVTLVIYAAKLFRHHDNRNRQGLRNLIMNGVTLRIMNLEDYRYCWRNFVAYQTGEDDYWPQNVTLYFLLNSTELLHIFWGLPPFLAN

SEQ ID NO: 631 - protein, 178 aa, unidentified
  source 1..178: note = MG138-33
MIHKSFLHRSCTQTEQPKVVYLMYAIKWRRGTIWRGWCSNNPTQHAEVNFLENCFKPLSSASCSITWVLSTTPCGKCSKRILEFLRIHPNVTLKIFAAKIFKHLDIRNRQGLRNLTEKGVIIRIMSPADYSSSWKRFVAYQHGEEDYWPWNFILHILLNCIELHRIILGLPPVLNLEY

SEQ ID NO: 632 - protein, 239 aa, unidentified
  source 1..239: note = MG138-34
MLDGRSLRDLSSGIETETNVRLIKEHPSVKGHLSPKRRRTNPEISMAAVTGRGSAPRPSNQRWKIQPNEFKRNYLPDKHPKVVYLLYEIRWRKGTTWRNWCSNNSTQHAEVNFLENCFKAMPSASCSITWVLSTTPCGKCSRRILEFLRVHPNVTLEIYAAKLFRHLDIRNLQGLRSLSTNGVIIRIMNLSDYSYCWKRFVAYQHGEDDYWPWSFSSYIFLNCMELFHILSGLPPLWEN

SEQ ID NO: 633 - protein, 190 aa, unidentified
  source 1..190: note = MG138-35
MAAVTDRDPAPRRNNQGWKIQPNDFKRNYLPDHHPEVVYLLYEIRWRRGTIWRNWCSNNSSQHAEVNFLENCFKATPSVSCSITWVLSTTPCGKCSKRILDFLRVHPNVTLEIYAAKLFKHLDIRNRQGLRNLALTGVAIRIMNLADYSYCWKTFVAHEHGQGDYWPLSFASYIFLNSTELSHILLDAVY

SEQ ID NO: 634 - protein, 194 aa, unidentified
  source 1..194: note = MG138-36
MAAVTDRDPAPRENNQRWKIQPKDFKRNYLPNQHPKMVCLLYEIRWSRGTIWRSWCSNNSTQHAEANFLKNCFKAKPSVSCSITWVLSTTPCGECSRRILDFLSVYPNVTLEIYAAKLFKHLDNRNRQGLQNLANNRVSIRIMNLEDYNYYWKRFVAYQHGEDDYWPWSFAPYIFLNWTELCHILLGLPPMLAN

SEQ ID NO: 635 - protein, 207 aa, unidentified
  source 1..207: note = MG138-37
MAAVTDRDPAPSRNNQGWKIQPNDFKRNYLPDHHPEVVYLLYEIKWRRGTIWRNWCSNNSSQHAEVNFLENCFKATPSVSCSITWVLSTTPCGKCSKRILDFLRVHPNVTLEIYAAKLFKHLDIRNRQGLRNLARTGVTIRIMNLADYSYCWKTFVAHEHGQGDYRPLSFASYIFLNSTELSHILWDLAPLPLRSVMQLPPFKCSCF

SEQ ID NO: 636 - protein, 203 aa, unidentified
  source 1..203: note = MG138-38
MAAVTDRDPAPRQNNQRWKIQPEYFKRNYLPNQHPKAVCLLYEIRWSRGTIWRNWCSNRSTQHAEVNFLENCFKANPSVSCSITWFLSTTPCGICSRRILDFLSGYPNVTLEIYAAKLFKHLDNRNRQGLWNLANNRVIIHIMSLSDYSYCWKRFVAYQNGEDDYWPWSFAPYIFLNWTELCHILLVSRHLKKTLRVKSNAKS

SEQ ID NO: 637 - protein, 188 aa, unidentified
  source 1..188: note = MG138-39
MAAVTDRDPAPRESNRGWKIQPNDFKRNYLPGQHPKVVYLLYEIRWSRGTIWRNWCSNNSTQHAEVNFLENCFKAMPSVSCSITWVLSTTPCGKCSRRILEFLRVHPSVTLEIYAAKLFKHLDIRNRQGLRNLAMNGVIIHIMNLADYSYWWKIFVAYRHGEEGYWPWSFASYIFLNQTELCHILLPS

SEQ ID NO: 638 - protein, 196 aa, unidentified
  source 1..196: note = MG138-40
MAAVIGRGRAPRQNNQRWKMQPDDFKSNYLPSQHPKVVCLLYAIKWRRGTIWRGWCTNNSTQHAEVNFLENCFKPLSSVSCSITWVLSTTPCGKCSKRILEFLRIHPNVTLEIFTAKIFKHLDIRNRQGLRNLMMKGVIIRIMRPADYSYSWKKFVAYQHGEEDYCPWSFSLYILLNCIELERIILGLPPLSNFEY

SEQ ID NO: 639 - protein, 236 aa, unidentified
  source 1..236: note = MG139-1
MFLAKFEEYSRKERNGANGQSAQLGLRYSLKGTINTLYKSFTVPRHPKLNEHTEQQIFTYIVSFLDFHKKKDETLTIYEIQIISHLSPCTDCAKKLAELPEALSKYHTHDSSQATYSIGSHGIFHRPAATLPEVNTELATSIKTMTSAKWKIEAVDEIPSLMLKPADMNSLDYFMLTTKDKPELRKKIAGINWDFRKAVAAELKLKEAAAASSASSQPAAAANSLMNPSPAVSNPK

SEQ ID NO: 640 - protein, 204 aa, unidentified
  source 1..204: note = MG139-2
MTAMTEQDIAADANKTSLTLRVNGQPFAVCTSEAGIHAESYACNFLLAALGNQDRGASALLAEAEQGSRPGGLPDKGCYDIFLTRSPCGACTDRILQVHNLLPENRTLRLFCATVYRGTRNAESRANIVRLKGHGVPVLFWDAARMALAGDIDSATLLRVAHHLSLWDSREADGGRADHKLGSRMASPDLGLLPLDTNSIYYAK

SEQ ID NO: 641 - protein, 328 aa, unidentified
  source 1..328: note = MG139-3
MPVGKYGTVYSESIAECQADKTSIIKTGYIFDPISMGGTANAFSLNDSQTLVVGLTKVGGYIFGRFCNSPGGSTVTYKIPNTVPQTGNHCEDFFMSAWDEVWDSPVMMELRVPYAIAARKLPVTLKLTKSPCHICAQKLIAFAEGYQIDLRLKILKLYSGDKGEIVNATALLAMLSKGIGVKMWEVHVVKQDYTGLTKKGQNHELRVLKEHLRAAEQQSHFLLTADSVEDIEERTESEKLQRNLSLQAIKQKVDAMLKWQTDINQFQWRSLERIQKTLSEINAGNLHGESQKKEIQQVLLAISNTALLKDVDEEFQYLSESYYQSEKL

SEQ ID NO: 642 - protein, 325 aa, unidentified
  source 1..325: note = MG139-4
MPRGKYGTYFTSKVESCISKDKPIVSGNYIFDPIDIGGGNNPFTLNSEYATVVLAKVCGIIFGRFCNNTGEPKKYKIGEETIIGDHSEDYFMATWEELWDEPIMKQIRALQDLQGKPIVITLKITKSPCDQCSKKLIKFIQHYNVNLRLKILRLYSGDQGPIVNSFALLSLASTGVAVKMWDVLAKEKGFQKKTKRGQTHEMKYMTQHLKSSFLMTIDEDDAVEEKEKSNIELLSDAFRKQILQMQEDSKQQLQKRLIEMNTKELHVKKTKAAIQKDFLQLSDGDYLYAISNMEDFLSPYLYSLVKEEKFSLELVCNAIGFDLCD

SEQ ID NO: 643 - protein, 319 aa, unidentified
  source 1..319: note = MG139-5
MVWHVNDIDSAVANSQPLVCYQQHGQYFIDPAWAGGGNNPFTLNPDQYTVVLIAKVNGVFFGRFLNNGLPRTISEPTKPINPSLKPELGITKTSKQAIERAEEKKLKAIRQYKKDQVSYEKNLKNYNNYLVQVNAQTFNHSHGSGTHAEDAFLSAWDAAVKKGTIGQLKERCNNKLYVTIKLSKSPCQVCAPKLIAFKKKSNDIFLRIKTQAIYEGDGGINVNTLEIKKMIGEGIAVRSWHIPFHSNKHQKNGAKTKSGMLHELSGWAFDEDDAFHKLLLEDLNIKKAKFDNKMAKGASSYAPENLEQRYKELSRNYKG

SEQ ID NO: 644 - protein, 315 aa, unidentified
  source 1..315: note = MG139-6
MWIFHTVDDVIERGSPIVANVQSQFQTPLIGGTANPYAAAISVEDDEKSYNVVSLVKLDGMIFGMFQMSTGPLPYEHSLGSSNHAEDGFISAFEMFTKTTFYDALTTVHEKLKKPISITLKQNKTPCETCAPKLVEFAKNYDLNIRIKAMIQYKGNNKSAQAATQSLVQSGIPVIPFNVPKRVGRKNYDTNRWGQPHELKYVKFDEQEIADGYMSGSIAELTRTMQNYKNAFSRKEQELAGVVASAIGANGSDQEIADAIAELYKSGDQRVKSTDTEFIKERLKVAAKVSMQIHGEIKQTETLAAQSGFGKALYL

SEQ ID NO: 645 - protein, 190 aa, unidentified
  source 1..190: note = MG139-7
MNGELDWADATAYYGSGLEAHRKPLSEASMATYGLLACRFLKGDTEQVVNGDGDHAEQKLIRSSLWTEELDSALADWDPRSSPMLVLVALNRSPCGDCAHLLASALNHYNDRYALTTERQHFVLASLGYYHSNKATQHSARGLPQTFTTDKGMRALKEAGWKLCTLTFDAKTTRRGRELSTYLRQIRKHG

SEQ ID NO: 646 - protein, 165 aa, unidentified
  source 1..165: note = MG139-8
MQNLSDNEWIAQTTYCVAELYSRGTQQTLDLGKFQSNGNGHAEDNLIAALVAQTTNGTIPHGTYDLLIILNRSPCTSLMPELKANHVPACMTRLIDLQTNGLGNGQWRFNIQLNYRHLYGGNPATNWNRALNAFGVQQGAASGMAIMHGEGFNDVSVAIEMSKLQ

SEQ ID NO: 647 - protein, 212 aa, unidentified
  source 1..212: note = MG139-9
MSPADVLALQRTAGNGAAVLMLQRARRQNGDDPVAGSEQARMQAPRRPGEVIQRLEDLTDNEWNGQATTLSADLELNGQLAQELSKFRSGGGLHAEDRLIDRLGELVDQGNLAAGHYQLVININRSPCGTIGGGKGCAERLIDLAQRGLGGPPATHTFAIVIHARHLYGSCSEERAYSQLAVQQMQHAGIQLALDIGHFDTGAAKALSNLET

SEQ ID NO: 648 - protein, 189 aa, unidentified
  source 1..189: note = MG139-10
MYSYQENAISRLSPNNTNHPKYQMDNRESATRQYNLISGINGDCIQGDFIYNRLITTEESSSTGYTTYAQVSFINEDDGNEVVIGTGISEDGVHAETEAIAGIQSFIDHSIDDEGTDASGTLSLIMRVSKSPCPACGQALIDFISNGHRGISFKLNIIADHLYHGSTLDEARQTISDMEAVGIIVSVTN

SEQ ID NO: 649 - protein, 311 aa, unidentified
  source 1..311: note = MG139-11
MLSQTLSLTLRQTNNSMENIALLRNYYYKITRGDQGHFFGLYAGNYFLSIDEAMEALRQVGPIFARRQANIVSGPIKLEKQVSNEKFLAGSDGKLVKKRREETEERRIIHKFKTNQMYSYQENAISRLSPNNTNHPKYQMDNRESATRQYNLISGINGDCIQGDFVYNRLTTTEESSSTGYTTYAQVSFINEDDDNEVVIGTGISEDGVHAETEAIAGIQSFIDHSIEEQQAAGDEQAADRGTLSLIMRVSKSPCPACGQALIDFISNKYNGVSLQLSIIADHLYHGSTLDEARQTISDMEAVGIIVSVTN

SEQ ID NO: 650 - protein, 359 aa, unidentified
  source 1..359: note = MG139-12
MTFLRMDIPDGPLAGRPVRSRMDGVHPVHGRVLALQRAAGNAATTSALGTVQRSVVDEIARMKPDQLVVALQELNPKAAATNLWVTVDGKPVTELISRPAGFESLWPIQSGRGPHAEERFAQGVMPLLAARQPRYILLEITKSPCPSCTALLSQLVGEHPGTRFELHMLGLYPGAGEAEGERGAATRPEDLAELERKLQAKLLDLRAVIDRLTDEQWRKRFKYPKHTKIPIGTRIAALKFARSVHTTMVEARLKLGERQDQTAYGAKLKDLEDKFAELAAFLTAKKADATASARHEPYPAHETGRPTPAAETVTDLDRWTAIKAECPDLQLSEQTYGEYFLYSSHRAFTWFYVHNSLPE

SEQ ID NO: 651 - protein, 310 aa, unidentified
  source 1..310: note = MG139-13
MYCERQINQESGIFSPSSLRKPQQYFEDKRAIQACFADWVSKLGQKPDIIFGKGSYGTGERLNLVQRKINYESLSKRVSLGEGEKNLESLISKLQDFYSRYGMKFKEKIRGWLEEINVQSDTWTLGDILRFLDARAKEEPIPIAPTEKGIAEVRLPFSMSAQRDFAFPAHTRAVAVFGQRMFEEQSSDGVHAEEQIVTRLQKLEAEVAELEVRERKLSITINNFPCLERCTPQIITLTTIFTTITIYYVIPYGGENFEAAARKLKSAGINLIPIDPRDYMTPEVKRDLTTDQAYRFEQAAKRRTLNPLPK

SEQ ID NO: 652 - protein, 368 aa, unidentified
  source 1..368: note = MG139-14
MREHEVQSSKEQIRTEKTQNQQSSIGMAASVMQLQKSIGNRATTKLMQSNFSSAQLPIQRTIKYKSNCKAFGFEGGYHGDNKVSLETITKAVKEKFPNISQTTINGYVNEMNESDEAWTLNDIYRYFTQLNKETPVPMADHEIDEDILLPQNQDERLWYGFTTKTLLRGKVGDDLSYEFHSITKEDGSIHAEPQYIEKMESIIDDDFDSETPFIWTINNSPCGECVKKIIRFKKKHNLENFTIYFMNPYGGTKEEFKDSLKDLTEEGINLLPFDPRSYLTEDDKKTMTPEQEGRIEHALRKQIEYTKGTAIEVNPLENDDSVSSQSSLEQGMGDNDLFSREEEDEPRENKRKVAALVGAEENTKKKRK

SEQ ID NO: 653 - protein, 211 aa, unidentified
  source 1..211: note = MG139-15
MAADRRLLKLHEALRRCPAPPPGRIVTMVARVAPALGVAIRDLPALDRGAGIPGGRVLPTWIDGAGALEIVTWNTGEASDLRRYGNRSHAEAQFFEFMRGRDFTSVDIEISHSPCTACADMLVGLLKSMKAKGTTVSRGPTRRVGQRVYVGAAIETPPVLPATLRWGALFETPPQATTPQSLRELQAVGWHMAAPRTAIPNDAGTPAITLL

SEQ ID NO: 654 - protein, 213 aa, unidentified
  source 1..213: note = MG139-16
MAVDRRLLKLHEALRRCSGQPPGRIVTMVARVTPALGVGIRDLPALDRGAGIPGGRVLPTWIDGSGGGALEIVTWNTGEASDLRRYGNRSHAEAQFFEFMRDRDFTSVEIEISHSPCTACADLLAGLLKSMKAKGTTVSRGPTRRVGQRVYVGAAMETPPVIPATLRWGALFETPPQATTPQSLRALQAVGWHMAAPGTAIPNGAGTPAIRLL

SEQ ID NO: 655 - protein, 188 aa, unidentified
  source 1..188: note = MG139-17
MAVDRRLLKLQEALRRCSAPPPGRVVTMVARVTPAPGVGIRDLPALDRGAGIPGGRVLPVWMDGSGALEIVTWNTGEASDLRRYGNRSHAEAQFFEFMRDREFKSVDIEISHSPCTACADMLAGLLKSMKAKGTAVTPGTNRRVGQRIYVGPAIETPPVLPATLRWGALFATPPQATTPQSLRALQAV

SEQ ID NO: 656 - protein, 186 aa, unidentified
  source 1..186: note = MG139-18
MAWTQQNENCSWVAGEAPYIFDNEYTANFISGFRTVLIAKIEAEGVGNQPFGKFFNDSDGHAEANFLQALRANEWVFDAGYQEIVISINNSPCRQCCVLFKQYMEEIQVRFPNTTLVIETANIYHPNDPQDQACLRALSRLPGIRVELWNVALVNAQNQGPQVSPAQELARINKSLRTADVVRRMP

SEQ ID NO: 657 - protein, 250 aa, unidentified
  source 1..250: note = MG139-19
MPECFDTLDTAFAAVARDKEKKRLWTILTFQGSNTFYLFWSAANAGQIVAGILNEDLPASDASLPTVLPNKALPQLKRGGVDKGHPEYEQNEINRQTVSKTKALRASVADVLAQQWKVNTWTFTGHAEERMLLNFGALYTQFAVASGQIPTVIIYNSDSPCTVDDPRASSFLQPRSCSAKLTHLAKRYPFAQFTIYYYKAYHGGGSASKDGASSSSSAGSTSPNFVSGDNIELLPFTPELRELCAQNNIK

SEQ ID NO: 658 - protein, 189 aa, unidentified
  source 1..189: note = MG139-20
MGLSTQIAESFYDSKFSFTPGTMSGVVCVFTTALEKDNPFFIKSITFNYGAHIEQELMIELHKKFGEGLNTLPANSKIIFYQYWSPCRTCTDATIPDFLRRFGLIEKNIRVKFRFIDYYSKANVPNSTKQELWETNAEAQQAYDIACISSGHAKVKTNPTTPNQTIESMYLVIAPVGNNKTSFLMTVHQ

SEQ ID NO: 659 - protein, 198 aa, unidentified
  source 1..198: note = MG139-21
MCSPLRELGKREREPSLTLRANFVGALGLSWRFIFEEAKNKWKYNNQIVGQGEGDCVAEIAMTDGSVVTGRYDEDKKGTHAEIMALSKIDQYDEIASITISSVPCPRCAVILERYNLSNKVIARPSDSTFGPSWHWPGTETELAFLLAGHVSDTIMKWSSLKTDVFGKFKGDSEWTKYPLKSTEFILDEVNKYDNQIK

SEQ ID NO: 660 - protein, 184 aa, unidentified
  source 1..184: note = MG141-1
MYKKKLRGMYISKKALKHHFDPRKAPRDAYLLCRLQWGETGTPWTHWVKNDRYHAEVYFLEKIFKMRRSNNYVNCSIAWYLSWSPCVNCCRKILNFLQQHSYVNINIYVARLYYIDDDEIRRNLKNLMSLVNVTIAVMEIEDYTFCWENFIQGDVDDDSWTVGFQSELTKNRLKLQDMLEVSRV

SEQ ID NO: 661 - protein, 181 aa, unidentified
  source 1..181: note = MG141-2
MYISKKALKHHFDPRKSPRDTYLLCKLQWGETGRPWIHWVRKDHCHAEVYFLEKILKIKRSNNYVNCSITWYLSWSPCAECCLKIQNFLERHSNVNIDIYVARLYYIEDEENRQGLKNLVSLEGVTIAVMKIEDYTRCWKTFIQGGDDYDDDSWTMGFQSKITENHRKLEDVFEDLPFVES

SEQ ID NO: 662 - protein, 185 aa, unidentified
  source 1..185: note = MG141-3
MYKRKLRGMYVSKRALKHQFDPRNTPKETYLLCKLQWGEASIPWIHWVRNDNYHAEVYFLEKIFKTRRTNNYVNCSITWYLSWSPCENCCYKILNFLKKHSYVNIDIHIARLFCIRDERIRQGLKNLVRLADVKISVMEIEDYTDCWKIFIQGDDNDDSWTEGFQSEITKNRLKLKDVFEDLPCI

SEQ ID NO: 663 - protein, 205 aa, unidentified
  source 1..205: note = MG142-1
MERSSGRDWLDECCPRGCKYTSNYRGPMKGLFQKAFYFHFENLHYADHRRKTFLCFEVTRLQDNKFRKGMFINQVGPYRLHAELRFLSWFHDSWLCPYASYEVTWYMSWSPCEECMEELAAFLANHRNVTLTIYVARLYYYQEPTCGEGLQALLNEGASVNIMFFRDFLDCWRRFVYNGNEYFEPWPHLHQNSLKYFHILEELLE

SEQ ID NO: 664 - protein, 207 aa, unidentified
  source 1..207: note = MG142-2
MGTCGTAELCPFPGDNRGNEMSGSRGSECLLPRMGAEQMREDALPVLPAPPAGDLALLPLLSQVGPQRLHAELSFLSWFHDTQPSLDESYRVTWYVSWSPCDECAKEIAKFLANHHNVTLTIYAARIYYYWKPTYKEGLQALAEGGAQISIMSLPEFEECWNLFVCKKTFRPWKNFLECYLLQDKTLKEILSPAVSSRTTQPELPYH

SEQ ID NO: 665 - protein, 222 aa, unidentified
  source 1..222: note = MG93-1
MSQDPVETAASRLPLSFRRRIEPWQFEACFDPRQLRKEACLLSEVRWGASPRTWRESCLNTARHVERNFIDKFASERRLQPSVRCSVTWFLSWSPCWECAGAIRAFLGQHPNVTLVICVARLFWHMEEQNRRGLGELLASGVRLQVMSESGNSSREGASREPGWRLPVQMGAGRPRQCDSSPRCLHGPQVALFPGARDGGQDFVRAVQALCPGAPHPEPQQS

SEQ ID NO: 666 - protein, 219 aa, unidentified
  source 1..219: note = MG93-2
MASEKGPSSKDYTWRTVTWEFEVFFGPRELHKEACLLYEIKWGTSSRTWRSSGKNTTNHVEVNFVEKLTSERRLCPSTCCSTTWLLSWSPCWECSRAIREFLSQHPGMTLVIFVARLFQHMDHRNRQGLKDLVTSGVTIRVMSVSEYCYCWEFCQLPTRESSSVATVPTSWMTMCALELHCTILSLPPCSKISRRHQNQLTFFRLTPQHCYYQMIPPSF

SEQ ID NO: 667 - protein, 245 aa, unidentified
  source 1..245: note = MG93-3
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYWHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 668 - protein, 236 aa, unidentified
  source 1..236: note = MG93-4
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 669 - protein, 229 aa, unidentified
  source 1..229: note = MG93-5
MTTMRGPAAGDATLRRRIEPWDFQDFFDPRDLRRETCLLYEINWGGRHSVWRHTGKNTSNHVEVNFIEKFTSERYYSPSARCSIIWFLSWSPCWECSKAIIEFLHQHRNVTLFIYVARLFHHTDLRNRQGIRDLISSGVTIQIMTEPEYCYCWRYFVNYPPGSEVHWPRYPRQWMMLYVLELQCIILGLPSCVKILRRHQNQLTIFTLDLQNCHYQMIPPHILLATGLI

SEQ ID NO: 670 - protein, 228 aa, unidentified
  source 1..228: note = MG93-6
MSSQTGPAVVDPTLRRRIEPQDFEAFFDPRELRKETCLLYEISWGGRHNTWRHTSRNTDKHVEINFIKKLTSERSFRPSARCSITWFLSWSPCWECSKAITEFLSQHPNVTLFIYVARLYHHMDPGNRQGLRNLVCRGVTVQIMTEQEYCYCWKNFVNYPPSNEVYWPRFPNVWMKLYILELLCIILGLPPCLRILRRNQCQATLFTLVFQGCHFQRIPPPIFWATGM

SEQ ID NO: 671 - protein, 228 aa, unidentified
  source 1..228: note = MG93-7
MSSETGPAVVDPTLRRRIEPQEFEVFFDPRELRKETCLLYEISWGGRRSIWRHTSRNTDKHVEINFIEKLTSERSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRQGTLFTLVFQRCHYQRIPPPIVWARGM

SEQ ID NO: 672 - protein, 236 aa, unidentified
  source 1..236: note = MG93-8
MTSEKGPSTGDATLRRRIEPWEFEVFFDPGKLRKETCMFYEIKWGTSHKIWRNSSKNTTNHVEVNFIEKFTAERHFCPSISCSITWFLSWSPCWECSKAIREFLSQHPNMILVIYTARLFQHMDQQNRQGLRDLINSGVTVQIMTVSEYCYCWRNFVNYPPKEETHWPKYQPLLMMLYALELHCIILSLPPCLKISRRCQKQLTFFSLTLQNCHYQTIPPHILLSTGLIQPSVTWR

SEQ ID NO: 673 - protein, 236 aa, unidentified
  source 1..236: note = MG93-9
MTSEKGPSTGDATLRRRIEPWEFEVFFNPGELRKETCMFYEIKWGTSQKIWRNSSKNTTNHVEVNFIEKFTAERHFCPSISCSITWFLSWSPCWECSKAIREFLSQHPNTTLVIYTARLFQHMDQQNRQGLRDLINSGVTVQIMTISEYCYCWRNFVNYSPKEETHWPKYQPLLMMLYALELHCIILSLPPCLKISRRYQKQLTFFNLILQNCHYQTIPPHILLSLGLIQPSVTWR

SEQ ID NO: 674 - protein, 223 aa, unidentified
  source 1..223: note = MG93-10
MTSLQGPSAGDPTLSPRQLRRETCLLSEVRWGASPRAWRECCLNAARHAEASFLHRLTLGGRLQGPARCTITWFLSWSPCRECARATGQFLRQHPNVSLVVYVARLFWHVDEQNRQGLRDLVAAGARVQVMSDPEFCHCWRNFVNYPPGQEARWPRFPPVWTMLYTLELCCVLLNLPPCLKISRRCHNQLAFFQLNLQNCHYRAIPPAVLFAVGLIHPFVAWA

SEQ ID NO: 675 - protein, 228 aa, unidentified
  source 1..228: note = MG93-11
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 676 - protein, 972 aa, synthetic construct
  source 1..972: note = MG68-4v1-nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 677 - protein, 972 aa, synthetic construct
  source 1..972: note = TadA (8.8m)-nMG34-1
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 678 - protein, 1591 aa, synthetic construct
  source 1..1591: note = MG68-4v1-nSpCas9
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 679 - DNA, 123 bp, synthetic construct; identical to SEQ ID NO: 489
  source 1..123: mol_type = other DNA; note = MG34-1

SEQ ID NO: 680 - DNA, 83 bp, synthetic construct
  source 1..83: mol_type = other DNA; note = SpCas9
gttttagagctagaaatagcaagttaaaataaggctagtccgttatcaacttgaaaaagtggcaccgagtcggtgcttttttt

SEQ ID NO: 681 - skipped

SEQ ID NO: 682 - DNA, 20 bp, synthetic construct
  source 1..20: mol_type = other DNA; note = Spacer targeting site 2
gggaaagacccagcatccgt

SEQ ID NO: 683 - DNA, 20 bp, synthetic construct
  source 1..20: mol_type = other DNA; note = Spacer targeting site 3
gctcccatcacatcaaccgg

SEQ ID NO: 684 - DNA, 20 bp, synthetic construct
  source 1..20: mol_type = other DNA; note = Spacer targeting site 4
ggtgagtgagtgtgtgcgtg

SEQ ID NO: 685 - DNA, 20 bp, synthetic construct
  source 1..20: mol_type = other DNA; note = Spacer targeting site 5
ggcttcaggttctaaatgag

SEQ ID NO: 686 - DNA, 20 bp, synthetic construct
  source 1..20: mol_type = other DNA; note = Spacer targeting site 6
gcagagagtcgccgtctcca

SEQ ID NO: 687 - DNA, 20 bp, synthetic construct
  source 1..20: mol_type = other DNA; note = Spacer targeting site 7
gatgagaaggagaagttctt

SEQ ID NO: 688 - DNA, 20 bp, synthetic construct
  source 1..20: mol_type = other DNA; note = Spacer targeting site 8
agcaaacgcgttcagggcct

SEQ ID NO: 689 - DNA, 20 bp, synthetic construct
  source 1..20: mol_type = other DNA; note = Spacer targeting site 9
tgagtccgagcagaagaaga

SEQ ID NO: 690 - DNA, 36 bp, synthetic construct
  source 1..36: mol_type = other DNA; note = NGS primer for ABE site 1
gctcttccgatctnnnnnctggctgagctaactgtg

SEQ ID NO: 691 - DNA, 39 bp, synthetic construct
  source 1..39: mol_type = other DNA; note = NGS primer for ABE site 1
gctcttccgatctnnnnnaactgtgcgtatgacatcatc

SEQ ID NO: 692 - DNA, 36 bp, synthetic construct
  source 1..36: mol_type = other DNA; note = NGS primer for ABE site 2
gctcttccgatctnnnnncatgcgccggcacgcccc

SEQ ID NO: 693 - DNA, 36 bp, synthetic construct
  source 1..36: mol_type = other DNA; note = NGS primer for ABE site 2
gctcttccgatctnnnnngggtctctagaccagcgt

SEQ ID NO: 694 - DNA, 38 bp, synthetic construct
  source 1..38: mol_type = other DNA; note = NGS primer for ABE site 3
gctcttccgatctnnnnngctcccatcacatcaaccgg

SEQ ID NO: 695 - DNA, 36 bp, synthetic construct
  source 1..36: mol_type = other DNA; note = NGS primer for ABE site 3
gctcttccgatctnnnnnccaccctagtcattggag

SEQ ID NO: 696 - DNA, 36 bp, synthetic construct
  source 1..36: mol_type = other DNA; note = NGS primer for ABE site 4
gctcttccgatctnnnnncacagggaagctgggtga

SEQ ID NO: 697 - DNA, 39 bp, synthetic construct
  source 1..39: mol_type = other DNA; note = NGS primer for ABE site 4
gctcttccgatctnnnnncacagatctattggaatcctg

SEQ ID NO: 698 - DNA, 36 bp, synthetic construct
  source 1..36: mol_type = other DNA; note = NGS primer for ABE site 5
gctcttccgatctnnnnnggtctttagcccagtctc

SEQ ID NO: 699 - DNA, 42 bp, synthetic construct
  source 1..42: mol_type = other DNA; note = NGS primer for ABE site 5
gctcttccgatctnnnnnatttcatggctgagtgaattcaaa

SEQ ID NO: 700 - DNA, 36 bp, synthetic construct
  source 1..36: mol_type = other DNA; note = NGS primer for ABE site 6
gctcttccgatctnnnnnagcgatccaggtgctgca

SEQ ID NO: 701 - DNA, 39 bp, synthetic construct
  source 1..39: mol_type = other DNA; note = NGS primer for ABE site 6
gctcttccgatctnnnnngacatgcatttcgaccaatag

SEQ ID NO: 702 - DNA, 41 bp, synthetic construct
  source 1..41: mol_type = other DNA; note = NGS primer for ABE site 7
gctcttccgatctnnnnnaagacatgaaaatgtgcttgatg

SEQ ID NO: 703 - DNA, 36 bp, synthetic construct
  source 1..36: mol_type = other DNA; note = NGS primer for ABE site 7
gctcttccgatctnnnnnctgaggagggcccccctg

SEQ ID NO: 704 - DNA, 36 bp, synthetic construct
  source 1..36: mol_type = other DNA; note = NGS primer for ABE site 8
gctcttccgatctnnnnntccagctccagccccaga

SEQ ID NO: 705 - DNA, 44 bp, synthetic construct
  source 1..44: mol_type = other DNA; note = NGS primer for ABE site 8
gctcttccgatctnnnnnaacaaaagagaggagttaatgaatta

SEQ ID NO: 706 - DNA, 37 bp, synthetic construct
  source 1..37: mol_type = other DNA; note = NGS primer for ABE site 9
gctcttccgatctnnnnngtgaaggtgtggttccaga

SEQ ID NO: 707 - DNA, 37 bp, synthetic construct
  source 1..37: mol_type = other DNA; note = NGS primer for ABE site 9
gctcttccgatctnnnnnatcgatgtcctccccattg

SEQ ID NO: 708 - DNA, 476 bp, synthetic construct
  source 1..476: mol_type = other DNA; note = Blasticidin engineered sequence for selection purposes
ccgacctctctccccagggggatccaccggagcttaagacgggactaggtcaggccgggtcaggttctggtttggatcaggctaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaa

SEQ ID NO: 709 - DNA, 22 bp, synthetic construct
  source 1..22: mol_type = other DNA; note = Spacer_MG3-6_g5
gacgggactaggtcaggccggg

SEQ ID NO: 710 - DNA, 22 bp, synthetic construct
  source 1..22: mol_type = other DNA; note = Spacer_MG3-6_g4
cttaagacgggactaggtcagg

SEQ ID NO: 711 - DNA, 22 bp, synthetic construct
  source 1..22: mol_type = other DNA; note = Spacer_MG3-6_g3
cggagcttaagacgggactagg

SEQ ID NO: 712 - DNA, 22 bp, synthetic construct
  source 1..22: mol_type = other DNA; note = Spacer_MG3-6_g2
tccaccggagcttaagacggga

SEQ ID NO: 713 - DNA, 22 bp, synthetic construct
  source 1..22: mol_type = other DNA; note = Spacer_MG3-6_g1
ggggatccaccggagcttaaga

SEQ ID NO: 714 - DNA, 22 bp, synthetic construct
  source 1..22: mol_type = other DNA; note = Spacer_Cas9_g6
cgggactaggtcaggccgggtc

SEQ ID NO: 715 - DNA, 22 bp, synthetic construct
  source 1..22: mol_type = other DNA; note = Spacer_Cas9_g5
taagacgggactaggtcaggcc

SEQ ID NO: 716 - DNA, 22 bp, synthetic construct
  source 1..22: mol_type = other DNA; note = Spacer_Cas9_g4
ttaagacgggactaggtcaggc

SEQ ID NO: 717 - DNA, 22 bp, synthetic construct
  source 1..22: mol_type = other DNA; note = Spacer_Cas9_g3
gagcttaagacgggactaggtc

SEQ ID NO: 718 - DNA, 22 bp, synthetic construct
  source 1..22: mol_type = other DNA; note = Spacer_Cas9_g2
caccggagcttaagacgggact

SEQ ID NO: 719 - DNA, 22 bp, synthetic construct
  source 1..22: mol_type = other DNA; note = Spacer_Cas9_g1
gggatccaccggagcttaagac

SEQ ID NO: 720 - DNA, 3348 bp, synthetic construct
  source 1..3348: mol_type = other DNA; note = pCMV
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcggatcccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgaagcttcatagttaagccagtatctgctcc

SEQ ID NO: 721 - DNA, 6263 bp, synthetic construct
  source 1..6263: mol_type = other DNA; note = pCMV-MG68-4v1-nMG34-1
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcgatgaccgactctcaaaatgacactgatgaatactggatgggtgaggctcttaaactggcgcagaaagcctgggacgaaggtgaagtgcctgttggcgccatcctggtccggaaaggggaagtgattgggcacgggtggaatcgaagcattgggtcacacgatccatccgctcatgcagaaattatggcgatcagagaggccggagttcgaatcggaaattatagaatgcttgataccgtgctgtacgtgaccttagagccctgcgcaatgtgcgcaggtgccctggttcatggaagaattagccggctggtgtttggagcagagaaccccaagactggggcttgtggatctgttatggacattgcaaggcatccagccctgaaccatcaactccaagttgatggcggagtcatggctgccccctgcgcccgcttattgtccgacttcttccgctggcgccgtgcgcaaaagaaagctgccagagataactctagcggaaatggtacctcaggcgggtcttccggcggcagtagtgggagcgaaacaccgggcacaagtgagagcgcaacaccggaatcatctggcggttcaagcggcggatccatggaacgcgaattggtcttgggaattgcgtatggcggaaagtacactggtctggccgtcgtcgataggagacataaccaagtgctctacgcaaatagactgaagatgagggatgatgtcgccggcattcttaaagaccgccggaagcaaaggggcatcaggcgcaccgcccaaacaaagaagaagcgtttgcgagaacttaagaattatctcaaaagtataggttacaatgagtcaaccgctacttttgaaacggtttactcactggctcacaagaggggctatgactatgctgatatgcccgaggaaaagactagtgaagaaattgaagcaatggacgtggaagagcggaaacaatgggaaaaggagaaacaagagtgggaagagactaaacgaaactctagacatcgtaaagaagtcgtgaaggatgtccacaaagctatgattgaaggcagggctactgaggaacaaattaaaagagtggaacggatatttaataaacaatacagacccaagcgattcaataatcgcatcctgacaaaatgcaaggtcgaagactgcggagtcaacacccctttgaggaagaatgttagggatctcctgatagaaaatattgtgaggttcttcccaatagaacaatctgaaaaggataacttgaaggacgccgtgttggataagaatagaagggaagaagtcaagtccttctttaggaaacataaaaccgatgagcatatacgcaaacaggtgtatgatatagccgataacaagctctctggcaggacagtcttttgcaaggagcacattctggaacacacagaacattctaaggaagagaggaaagtattcagactcgctccgagtcttaagaccaaaatagagaatgtccttgccgtaattaaagatgaaatcctgcctaagttcaccgtcaataaagtcgtgatggagtctaacaatttcgacatcgctgccaaaactcaaggcaagaaacggctcgccaaagaagagtatggtaagggaccacgtgaaggcaaagaaaccaggaaagaagctctcctgcgggagactgatggcagatgcatatattgtgggaagtcaatagatatctccaatgctcatgacgaccatatctttcctcgaaaggccggcggactgaacatcttcgcaaatcttgtagcatgctgtgccgtgtgtaatgagaataagaaagggcggacacctctggaatcaggtattagcccaaagccagagatcatcgctttcatgaagaatgatctcaagaagaagatccttgaagacgcccgaaacataaacacggtggatttcaataagtacatgtcacatgccagcattggctggagatatatgagagaccgacttagggaatctgccgggaataagaagctcccgattgagaggcaaagcgggatctatacggcatactttcggagatggtggggattcaagaaggagcggggcaatacactccaccatgccttggatgctgttatcctggcgtcccggaaaggatatagcgatgacgggttggttgacatgacattgaaacctaaatacaacaaaggtggagagttcgatccagaaaagcacctgccagaacctattgagttcaaaatggacaaaggttccaggggatctgcacttcatgatagaaaccccttgtcctataagaagggaattattactcgtaggttcatggtcactgaaatcgagtgcgggaaagaggatgacgtgatctcagaaacttacagagagaaactcaaagaggcattcaagcgctttgataccaagaaaggaaaatgtctgaccgacaaggaagccaaagaggccggattctgcatcaagaagaatgagctggtgatgagtcttaaatgttccatcaaaggaacaggccctgggcaaatgattcgcattaacaacaatgtattcaaaactaacgttcataatgttggggttgatgtttatctcgacgagaaaggcaagaagaaagcctacgaaagaaagaacccgcggttgagcaaacatttcattgagccaccaccacagcctaatggaagggttagcttcactctcaaacggagagacatggtaactgtcgagggagaagatgcaatttataggatcaagaagctcggtacatctcccactatagaggccgtcgtaggatcagacggaaagacccggactgtgtcagcaacaaaacttaccaaggctaacagtgctgagctcgaggagggagctgataagcgcaccgccgatggttccgagttcgaaagccccaagaagaagaggaaagtctaaccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgaagcttcatagttaagccagtatctgctcc

SEQ ID NO: 722 - DNA, 6263 bp, synthetic construct
  source 1..6263: mol_type = other DNA; note = pCMV-TadA*(8.8m)-nMG34-1
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcgatgagcgaagtcgaattttcccatgagtactggatgcggcatgcacttacattggctaaaagagctagggacgaacgcgaagtaccagtaggcgcagtactggtcttaaacaatagggtgataggggaaggatggaaccgggcaatcgggttacacgaccctacagcgcatgcagaaattatggctttgcggcaaggtggccttgtcatgcagaattataggctcatagatgcgacgctgtatgtgacattcgagccttgtgtaatgtgtgctggcgccatgattcattcaaggattggacgcgtagtgttcggagtgcgaaacgcaaagacaggagccgctgggagtttaatggacgtattacatcatcctggcatgaatcacagggtggaaatcaccgaagggattctcgccgatgagtgtgcggctcttctttgtaggttctttcgtatgcctcggcgcgtgttcaacgcgcagaagaaggcacaaagcagtacagatggtacctcaggcgggtcttccggcggcagtagtgggagcgaaacaccgggcacaagtgagagcgcaacaccggaatcatctggcggttcaagcggcggatccatggaacgcgaattggtcttgggaattgcgtatggcggaaagtacactggtctggccgtcgtcgataggagacataaccaagtgctctacgcaaatagactgaagatgagggatgatgtcgccggcattcttaaagaccgccggaagcaaaggggcatcaggcgcaccgcccaaacaaagaagaagcgtttgcgagaacttaagaattatctcaaaagtataggttacaatgagtcaaccgctacttttgaaacggtttactcactggctcacaagaggggctatgactatgctgatatgcccgaggaaaagactagtgaagaaattgaagcaatggacgtggaagagcggaaacaatgggaaaaggagaaacaagagtgggaagagactaaacgaaactctagacatcgtaaagaagtcgtgaaggatgtccacaaagctatgattgaaggcagggctactgaggaacaaattaaaagagtggaacggatatttaataaacaatacagacccaagcgattcaataatcgcatcctgacaaaatgcaaggtcgaagactgcggagtcaacacccctttgaggaagaatgttagggatctcctgatagaaaatattgtgaggttcttcccaatagaacaatctgaaaaggataacttgaaggacgccgtgttggataagaatagaagggaagaagtcaagtccttctttaggaaacataaaaccgatgagcatatacgcaaacaggtgtatgatatagccgataacaagctctctggcaggacagtcttttgcaaggagcacattctggaacacacagaacattctaaggaagagaggaaagtattcagactcgctccgagtcttaagaccaaaatagagaatgtccttgccgtaattaaagatgaaatcctgcctaagttcaccgtcaataaagtcgtgatggagtctaacaatttcgacatcgctgccaaaactcaaggcaagaaacggctcgccaaagaagagtatggtaagggaccacgtgaaggcaaagaaaccaggaaagaagctctcctgcgggagactgatggcagatgcatatattgtgggaagtcaatagatatctccaatgctcatgacgaccatatctttcctcgaaaggccggcggactgaacatcttcgcaaatcttgtagcatgctgtgccgtgtgtaatgagaataagaaagggcggacacctctggaatcaggtattagcccaaagccagagatcatcgctttcatgaagaatgatctcaagaagaagatccttgaagacgcccgaaacataaacacggtggatttcaataagtacatgtcacatgccagcattggctggagatatatgagagaccgacttagggaatctgccgggaataagaagctcccgattgagaggcaaagcgggatctatacggcatactttcggagatggtggggattcaagaaggagcggggcaatacactccaccatgccttggatgctgttatcctggcgtcccggaaaggatatagcgatgacgggttggttgacatgacattgaaacctaaatacaacaaaggtggagagttcgatccagaaaagcacctgccagaacctattgagttcaaaatggacaaaggttccaggggatctgcacttcatgatagaaaccccttgtcctataagaagggaattattactcgtaggttcatggtcactgaaatcgagtgcgggaaagaggatgacgtgatctcagaaacttacagagagaaactcaaagaggcattcaagcgctttgataccaagaaaggaaaatgtctgaccgacaaggaagccaaagaggccggattctgcatcaagaagaatgagctggtgatgagtcttaaatgttccatcaaaggaacaggccctgggcaaatgattcgcattaacaacaatgtattcaaaactaacgttcataatgttggggttgatgtttatctcgacgagaaaggcaagaagaaagcctacgaaagaaagaacccgcggttgagcaaacatttcattgagccaccaccacagcctaatggaagggttagcttcactctcaaacggagagacatggtaactgtcgagggagaagatgcaatttataggatcaagaagctcggtacatctcccactatagaggccgtcgtaggatcagacggaaagacccggactgtgtcagcaacaaaacttaccaaggctaacagtgctgagctcgaggagggagctgataagcgcaccgccgatggttccgagttcgaaagccccaagaagaagaggaaagtctaaccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgaagcttcatagttaagccagtatctgctcc

SEQ ID NO: 723 - DNA, 8120 bp, synthetic construct
  source 1..8120: mol_type = other DNA; note = pCMV-MG68-4v1-nSpCas9
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcgatgaccgactctcaaaatgacactgatgaatactggatgggtgaggctcttaaactggcgcagaaagcctgggacgaaggtgaagtgcctgttggcgccatcctggtccggaaaggggaagtgattgggcacgggtggaatcgaagcattgggtcacacgatccatccgctcatgcagaaattatggcgatcagagaggccggagttcgaatcggaaattatagaatgcttgataccgtgctgtacgtgaccttagagccctgcgcaatgtgcgcaggtgccctggttcatggaagaattagccggctggtgtttggagcagagaaccccaagactggggcttgtggatctgttatggacattgcaaggcatccagccctgaaccatcaactccaagttgatggcggagtcatggctgccccctgcgcccgcttattgtccgacttcttccgctggcgccgtgcgcaaaagaaagctgccagagataactctagcggaaatggtacctcaggcgggtcttccggcggcagtagtgggagcgaaacaccgggcacaagtgagagcgcaacaccggaatcatctggcggttcaagcggcggatccatggataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacgagggagctgataagcgcaccgccgatggttccgagttcgaaagccccaagaagaagaggaaagtctaaccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgaagcttcatagttaagccagtatctgctcc

SEQ ID NO: 724 - DNA, 6653 bp, synthetic construct
  source 1..6653: mol_type = other DNA; note = pCMV-MG68-4v1-nMG34-1_sgRNA 1
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcgatgaccgactctcaaaatgacactgatgaatactggatgggtgaggctcttaaactggcgcagaaagcctgggacgaaggtgaagtgcctgttggcgccatcctggtccggaaaggggaagtgattgggcacgggtggaatcgaagcattgggtcacacgatccatccgctcatgcagaaattatggcgatcagagaggccggagttcgaatcggaaattatagaatgcttgataccgtgctgtacgtgaccttagagccctgcgcaatgtgcgcaggtgccctggttcatggaagaattagccggctggtgtttggagcagagaaccccaagactggggcttgtggatctgttatggacattgcaaggcatccagccctgaaccatcaactccaagttgatggcggagtcatggctgccccctgcgcccgcttattgtccgacttcttccgctggcgccgtgcgcaaaagaaagctgccagagataactctagcggaaatggtacctcaggcgggtcttccggcggcagtagtgggagcgaaacaccgggcacaagtgagagcgcaacaccggaatcatctggcggttcaagcggcggatccatggaacgcgaattggtcttgggaattgcgtatggcggaaagtacactggtctggccgtcgtcgataggagacataaccaagtgctctacgcaaatagactgaagatgagggatgatgtcgccggcattcttaaagaccgccggaagcaaaggggcatcaggcgcaccgcccaaacaaagaagaagcgtttgcgagaacttaagaattatctcaaaagtataggttacaatgagtcaaccgctacttttgaaacggtttactcactggctcacaagaggggctatgactatgctgatatgcccgaggaaaagactagtgaagaaattgaagcaatggacgtggaagagcggaaacaatgggaaaaggagaaacaagagtgggaagagactaaacgaaactctagacatcgtaaagaagtcgtgaaggatgtccacaaagctatgattgaaggcagggctactgaggaacaaattaaaagagtggaacggatatttaataaacaatacagacccaagcgattcaataatcgcatcctgacaaaatgcaaggtcgaagactgcggagtcaacacccctttgaggaagaatgttagggatctcctgatagaaaatattgtgaggttcttcccaatagaacaatctgaaaaggataacttgaaggacgccgtgttggataagaatagaagggaagaagtcaagtccttctttaggaaacataaaaccgatgagcatatacgcaaacaggtgtatgatatagccgataacaagctctctggcaggacagtcttttgcaaggagcacattctggaacacacagaacattctaaggaagagaggaaagtattcagactcgctccgagtcttaagaccaaaatagagaatgtccttgccgtaattaaagatgaaatcctgcctaagttcaccgtcaataaagtcgtgatggagtctaacaatttcgacatcgctgccaaaactcaaggcaagaaacggctcgccaaagaagagtatggtaagggaccacgtgaaggcaaagaaaccaggaaagaagctctcctgcgggagactgatggcagatgcatatattgtgggaagtcaatagatatctccaatgctcatgacgaccatatctttcctcgaaaggccggcggactgaacatcttcgcaaatcttgtagcatgctgtgccgtgtgtaatgagaataagaaagggcggacacctctggaatcaggtattagcccaaagccagagatcatcgctttcatgaagaatgatctcaagaagaagatccttgaagacgcccgaaacataaacacggtggatttcaataagtacatgtcacatgccagcattggctggagatatatgagagaccgacttagggaatctgccgggaataagaagctcccgattgagaggcaaagcgggatctatacggcatactttcggagatggtggggattcaagaaggagcggggcaatacactccaccatgccttggatgctgttatcctggcgtcccggaaaggatatagcgatgacgggttggttgacatgacattgaaacctaaatacaacaaaggtggagagttcgatccagaaaagcacctgccagaacctattgagttcaaaatggacaaaggttccaggggatctgcacttcatgatagaaaccccttgtcctataagaagggaattattactcgtaggttcatggtcactgaaatcgagtgcgggaaagaggatgacgtgatctcagaaacttacagagagaaactcaaagaggcattcaagcgctttgataccaagaaaggaaaatgtctgaccgacaaggaagccaaagaggccggattctgcatcaagaagaatgagctggtgatgagtcttaaatgttccatcaaaggaacaggccctgggcaaatgattcgcattaacaacaatgtattcaaaactaacgttcataatgttggggttgatgtttatctcgacgagaaaggcaagaagaaagcctacgaaagaaagaacccgcggttgagcaaacatttcattgagccaccaccacagcctaatggaagggttagcttcactctcaaacggagagacatggtaactgtcgagggagaagatgcaatttataggatcaagaagctcggtacatctcccactatagaggccgtcgtaggatcagacggaaagacccggactgtgtcagcaacaaaacttaccaaggctaacagtgctgagctcgaggagggagctgataagcgcaccgccgatggttccgagttcgaaagccccaagaagaagaggaaagtctaaccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaacacaaagcatagactgcgttacagttaagaaattaattgtaaaacgcctatacagtgaagggatatacgcttgggtttgtccagcctgagcctctatgccagaaatggcgccttcatcgtgggttaggacatttaatttttttcatagttaagccagtatctgctcc

SEQ ID NO: 725 - DNA, 6653 bp, synthetic construct
  source 1..6653: mol_type = other DNA; note = pCMV-TadA*(8.8m)-nMG34-1_sgRNA 1
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcgatgagcgaagtcgaattttcccatgagtactggatgcggcatgcacttacattggctaaaagagctagggacgaacgcgaagtaccagtaggcgcagtactggtcttaaacaatagggtgataggggaaggatggaaccgggcaatcgggttacacgaccctacagcgcatgcagaaattatggctttgcggcaaggtggccttgtcatgcagaattataggctcatagatgcgacgctgtatgtgacattcgagccttgtgtaatgtgtgctggcgccatgattcattcaaggattggacgcgtagtgttcggagtgcgaaacgcaaagacaggagccgctgggagtttaatggacgtattacatcatcctggcatgaatcacagggtggaaatcaccgaagggattctcgccgatgagtgtgcggctcttctttgtaggttctttcgtatgcctcggcgcgtgttcaacgcgcagaagaaggcacaaagcagtacagatggtacctcaggcgggtcttccggcggcagtagtgggagcgaaacaccgggcacaagtgagagcgcaacaccggaatcatctggcggttcaagcggcggatccatggaacgcgaattggtcttgggaattgcgtatggcggaaagtacactggtctggccgtcgtcgataggagacataaccaagtgctctacgcaaatagactgaagatgagggatgatgtcgccggcattcttaaagaccgccggaagcaaaggggcatcaggcgcaccgcccaaacaaagaagaagcgtttgcgagaacttaagaattatctcaaaagtataggttacaatgagtcaaccgctacttttgaaacggtttactcactggctcacaagaggggctatgactatgctgatatgcccgaggaaaagactagtgaagaaattgaagcaatggacgtggaagagcggaaacaatgggaaaaggagaaacaagagtgggaagagactaaacgaaactctagacatcgtaaagaagtcgtgaaggatgtccacaaagctatgattgaaggcagggctactgaggaacaaattaaaagagtggaacggatatttaataaacaatacagacccaagcgattcaataatcgcatcctgacaaaatgcaaggtcgaagactgcggagtcaacacccctttgaggaagaatgttagggatctcctgatagaaaatattgtgaggttcttcccaatagaacaatctgaaaaggataacttgaaggacgccgtgttggataagaatagaagggaagaagtcaagtccttctttaggaaacataaaaccgatgagcatatacgcaaacaggtgtatgatatagccgataacaagctctctggcaggacagtcttttgcaaggagcacattctggaacacacagaacattctaaggaagagaggaaagtattcagactcgctccgagtcttaagaccaaaatagagaatgtccttgccgtaattaaagatgaaatcctgcctaagttcaccgtcaataaagtcgtgatggagtctaacaatttcgacatcgctgccaaaactcaaggcaagaaacggctcgccaaagaagagtatggtaagggaccacgtgaaggcaaagaaaccaggaaagaagctctcctgcgggagactgatggcagatgcatatattgtgggaagtcaatagatatctccaatgctcatgacgaccatatctttcctcgaaaggccggcggactgaacatcttcgcaaatcttgtagcatgctgtgccgtgtgtaatgagaataagaaagggcggacacctctggaatcaggtattagcccaaagccagagatcatcgctttcatgaagaatgatctcaagaagaagatccttgaagacgcccgaaacataaacacggtggatttcaataagtacatgtcacatgccagcattggctggagatatatgagagaccgacttagggaatctgccgggaataagaagctcccgattgagaggcaaagcgggatctatacggcatactttcggagatggtggggattcaagaaggagcggggcaatacactccaccatgccttggatgctgttatcctggcgtcccggaaaggatatagcgatgacgggttggttgacatgacattgaaacctaaatacaacaaaggtggagagttcgatccagaaaagcacctgccagaacctattgagttcaaaatggacaaaggttccaggggatctgcacttcatgatagaaaccccttgtcctataagaagggaattattactcgtaggttcatggtcactgaaatcgagtgcgggaaagaggatgacgtgatctcagaaacttacagagagaaactcaaagaggcattcaagcgctttgataccaagaaaggaaaatgtctgaccgacaaggaagccaaagaggccggattctgcatcaagaagaatgagctggtgatgagtcttaaatgttccatcaaaggaacaggccctgggcaaatgattcgcattaacaacaatgtattcaaaactaacgttcataatgttggggttgatgtttatctcgacgagaaaggcaagaagaaagcctacgaaagaaagaacccgcggttgagcaaacatttcattgagccaccaccacagcctaatggaagggttagcttcactctcaaacggagagacatggtaactgtcgagggagaagatgcaatttataggatcaagaagctcggtacatctcccactatagaggccgtcgtaggatcagacggaaagacccggactgtgtcagcaacaaaacttaccaaggctaacagtgctgagctcgaggagggagctgataagcgcaccgccgatggttccgagttcgaaagccccaagaagaagaggaaagtctaaccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaacacaaagcatagactgcgttacagttaagaaattaattgtaaaacgcctatacagtgaagggatatacgcttgggtttgtccagcctgagcctctatgccagaaatggcgccttcatcgtgggttaggacatttaatttttttcatagttaagccagtatctgctcc

SEQ ID NO: 726 - DNA, 8468 bp, synthetic construct
  source 1..8468: mol_type = other DNA; note = pCMV-MG68-4v1-nSpCas9_sgRNA 1
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcgatgaccgactctcaaaatgacactgatgaatactggatgggtgaggctcttaaactggcgcagaaagcctgggacgaaggtgaagtgcctgttggcgccatcctggtccggaaaggggaagtgattgggcacgggtggaatcgaagcattgggtcacacgatccatccgctcatgcagaaattatggcgatcagagaggccggagttcgaatcggaaattatagaatgcttgataccgtgctgtacgtgaccttagagccctgcgcaatgtgcgcaggtgccctggttcatggaagaattagccggctggtgtttggagcagagaaccccaagactggggcttgtggatctgttatggacattgcaaggcatccagccctgaaccatcaactccaagttgatggcggagtcatggctgccccctgcgcccgcttattgtccgacttcttccgctggcgccgtgcgcaaaagaaagctgccagagataactctagcggaaatggtacctcaggcgggtcttccggcggcagtagtgggagcgaaacaccgggcacaagtgagagcgcaacaccggaatcatctggcggttcaagcggcggatccatggataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacgagggagctgataagcgcaccgccgatggttccgagttcgaaagccccaagaagaagaggaaagtctaaccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaacacaaagcatagactgcgttttagagctagaaatagcaagttaaaataaggctagtccgttatcaacttgaaaaagtggcaccgagtcggtgcttttttttcatagttaagccagtatctgctcc

SEQ ID NO: 727 - protein, 969 aa, synthetic construct; identical to SEQ ID NO: 586
  source 1..969: note = TadA*(8.17m)-nMG34-1

SEQ ID NO: 728 - protein, 1588 aa, synthetic construct
  source 1..1588: note = TadA*(8.17m)-nSpCas9
MGSSHHHHHHSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGGSPKKKRKV

SEQ ID NO: 729 - DNA, 22 bp, synthetic construct
  source 1..22: mol_type = other DNA; note = Spacer 1 for TadA*(8.17m)-nMG34-1 targeting in E. coli
tctttatggcagggtgaaacgc

SEQ ID NO: 730 - DNA, 22 bp, synthetic construct
  source 1..22: mol_type = other DNA; note = Spacer 2 for TadA*(8.17m)-nMG34-1 targeting in E. coli
gaaatcccgaatctctatcgtg

SEQ ID NO: 731 - DNA, 22 bp, synthetic construct
  source 1..22: mol_type = other DNA; note = Spacer 3 for TadA*(8.17m)-nMG34-1 targeting in E. coli
atgagcgaacgcgtaacgcgaa

SEQ ID NO: 732 - DNA, 22 bp, synthetic construct
  source 1..22: mol_type = other DNA; note = Spacer 4 for TadA*(8.17m)-nMG34-1 targeting in E. coli
gccggtcgctaccattaccagt

SEQ ID NO: 733 - DNA, 20 bp, synthetic construct
  source 1..20: mol_type = other DNA; note = Spacer 1 for TadA*(8.17m)-nSpCas9 targeting in E. coli
tttatggcagggtgaaacgc

SEQ ID NO: 734 - DNA, 20 bp, synthetic construct
  source 1..20: mol_type = other DNA; note = Spacer 2 for TadA*(8.17m)-nSpCas9 targeting in E. coli
aatcccgaatctctatcgtg

SEQ ID NO: 735 - DNA, 20 bp, synthetic construct
  source 1..20: mol_type = other DNA; note = Spacer 3 for TadA*(8.17m)-nSpCas9 targeting in E. coli
gagcgaacgcgtaacgcgaa

SEQ ID NO: 736 - DNA, 20 bp, synthetic construct
  source 1..20: mol_type = other DNA; note = Spacer 4 for TadA*(8.17m)-nSpCas9 targeting in E. coli
cggtcgctaccattaccagt

SEQ ID NO: 737 - DNA, 8520 bp, synthetic construct; identical to SEQ ID NO: 484
  source 1..8520: mol_type = other DNA; note = pCMV-TadA*(8.17m)-nMG34-1_sgRNA 1

SEQ ID NO: 738 - DNA, 10396 bp, synthetic construct
  source 1..10396: mol_type = other DNA; note = pCMV-TadA*(8.17m)-nSpCas9_sgRNA 1
gaaataattttgtttaactttaagaaggagatataccatgggcagcagtcatcatcatcaccatcactccgaggttgaatttagtcatgaatattggatgcgccacgcgctgacgttagccaaacgtgctcgtgatgagcgcgaagttccagtcggggccgtcttggtccttaacaatcgtgtcattggcgaggggtggaaccgcgctattgggctgcacgatccaacagcgcatgctgagattatggccttgcgtcaaggagggttagtaatgcaaaactaccgtcttattgatgctacgttatactctacattcgaaccctgtgtaatgtgtgcaggagcgatgatccacagtcgtattggccgcgtagtatttggtgtacgcaatgctaaaactggagccgccggatcgttgatggatgtcttgcattaccctggaatgaaccatcgtgtagagatcactgaaggcatccttgccgatgagtgtgcggctttgctttgctatttcttccgtatgccacgtcgtgtttttaacgcccaaaaaaaggctcaatccagtaccgattcaggcgggtcgtcgggaggaagcagtggcagcgagactcccggaacttcggagagcgctacaccagaaagtagtggaggcagctctggtgggtccatggataagaaatactcaataggactggcgattggcacaaatagcgtcggatgggctgtgatcactgatgaatataaggttccttctaaaaagttcaaggttctgggaaatacagaccgccacagtatcaaaaaaaatcttataggggctcttctgtttgacagtggagagacagccgaagctactagactcaaacggacagctaggagaaggtatacaagacggaagaataggatttgttatctccaggagattttttcaaatgagatggccaaagtggatgatagtttctttcatagacttgaagagtcttttttggtggaagaagacaagaagcatgaaagacatcctatttttggaaatatagtggatgaagttgcttatcacgagaaatatccaactatctatcatctgagaaaaaaattggtggattctactgataaagccgatttgcgcctgatctatttggccctggcccacatgattaagtttagaggtcattttttgattgagggcgatctgaatcctgataatagtgatgtggacaaactgtttatccagttggtgcaaacctacaatcaactgtttgaagaaaaccctattaacgcaagtggagtggatgctaaagccattctttctgcaagattgagtaaatcaagaagactggaaaatctcattgctcagctccccggtgagaagaaaaatggcctgtttgggaatctcattgctttgtcattgggtttgacccctaattttaaatcaaattttgatttggcagaagatgctaaactccagctttcaaaagatacttacgatgatgatctggataatctgttggctcaaattggagatcaatatgctgatttgtttttggcagctaagaatctgtcagatgctattctgctttcagacatcctgagagtgaatactgaaataactaaggctcccctgtcagcttcaatgattaaacgctacgatgaacatcatcaagacttgactcttctgaaagccctggttagacaacaacttccagaaaagtataaagaaatcttttttgatcaatcaaaaaacggatatgcaggttatattgatggcggcgcaagccaagaagaattttataaatttatcaaaccaattctggaaaaaatggatggtactgaggaactgttggtgaaactgaatagagaagatttgctgcgcaagcaacggacctttgacaacggctctattccccatcaaattcacttgggtgagctgcatgctattttgagaagacaagaagacttttatccatttctgaaagacaatagagagaagattgaaaaaatcttgacttttaggattccttattatgttggtccattggccagaggcaatagtaggtttgcatggatgactcggaagtctgaagaaacaattaccccatggaattttgaagaagttgtcgataaaggtgcttcagctcaatcatttattgaacgcatgacaaactttgataaaaatcttccaaatgaaaaagtgctgccaaaacatagtttgctttatgagtattttaccgtttataacgaattgacaaaggtcaaatatgttactgaaggaatgagaaaaccagcatttctttcaggtgaacagaagaaagccattgttgatctgctcttcaaaacaaataggaaagtgaccgttaagcaactgaaagaagattatttcaaaaaaatagaatgttttgatagtgttgaaatttcaggagttgaagatagatttaatgcttcactgggtacataccatgatttgctgaaaattattaaagataaagattttttggataatgaagaaaatgaagacatcctggaggatattgttctgacattgaccctgtttgaagatagggagatgattgaggaaagacttaaaacatacgctcacctctttgatgataaggtgatgaaacagcttaaaagacgcagatatactggttggggaaggttgtccagaaaattgattaatggtattagggataagcaatctggcaaaacaatactggattttttgaaatcagatggttttgccaatcgcaattttatgcagctcatccatgatgatagtttgacatttaaagaagacatccaaaaagcacaagtgtctggacaaggcgatagtctgcatgaacatattgcaaatctggctggtagccctgctattaaaaaaggtattctccagactgtgaaagttgttgatgaattggtcaaagtgatggggcggcataagccagaaaatatcgttattgaaatggcaagagaaaatcagacaactcaaaagggccagaaaaattccagagagaggatgaaaagaatcgaagaaggtatcaaagaactgggaagtcagattcttaaagagcatcctgttgaaaatactcaattgcaaaatgaaaagctctatctctattatctccaaaatggaagagatatgtatgtggaccaagaactggatattaataggctgagtgattatgatgtcgatcacattgttccacaaagtttccttaaagacgattcaatagacaataaggtcctgaccaggtctgataaaaatagaggtaaatccgataacgttccaagtgaagaagtggtcaaaaagatgaaaaactattggagacaacttctgaacgccaagctgatcactcaaaggaagtttgataatctgaccaaagctgaaagaggaggtttgagtgaacttgataaagctggttttatcaaacgccaattggttgaaactcgccaaatcactaagcatgtggcacaaattttggatagtcgcatgaatactaaatacgatgaaaatgataaacttattagagaggttaaagtgattaccctgaaatctaaactggtttctgacttcagaaaagatttccaattctataaagtgagagagattaacaattaccatcatgcccatgatgcctatctgaatgccgtcgttggaactgctttgattaagaaatatccaaaacttgaaagcgagtttgtctatggtgattataaagtttatgatgttaggaaaatgattgctaagtctgagcaagaaataggcaaagcaaccgcaaagtatttcttttactctaatatcatgaacttcttcaaaacagaaattacacttgcaaatggagagattcgcaaacgccctctgatcgaaactaatggggaaactggagaaattgtctgggataaagggagagattttgccacagtgcgcaaagtgttgtccatgccccaagtcaatatcgtcaagaaaacagaagtgcagacaggcggattctctaaggagtcaattctgccaaaaagaaattccgacaagctgattgctaggaaaaaagactgggacccaaaaaaatatggtggttttgatagtccaaccgtggcttattcagtcctggtggttgctaaggtggaaaaagggaaatccaagaagctgaaatccgttaaagagctgctggggatcacaattatggaaagaagttcctttgaaaaaaatcccattgactttctggaagctaaaggatataaggaagttaaaaaagacctgatcattaaactgcctaaatatagtctttttgagctggaaaacggtaggaaacggatgctggctagtgccggagaactgcaaaaaggaaatgagctggctctgccaagcaaatatgtgaattttctgtatctggctagtcattatgaaaagttgaagggtagtccagaagataacgaacaaaaacaattgtttgtggagcagcataagcattatctggatgagattattgagcaaatcagtgaattttctaagagagttattctggcagatgccaatctggataaagttcttagtgcatataacaaacatagagacaaaccaataagagaacaagcagaaaatatcattcatctgtttaccttgaccaatcttggagcacccgctgcttttaaatactttgatacaacaattgataggaaaagatatacctctacaaaagaagttctggatgccactcttatccatcaatccatcactggtctttatgaaacacgcattgatttgagtcagctgggaggtgacggctctggcgggtctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaattctcgagtgcggccgcaagcttgtcgacggagctcgaattcggatcctaatacgactcactatagtttatggcagggtgaaacgcgttttagagctagaaatagcaagttaaaataaggctagtccgttatcaacttgaaaaagtggcaccgagtcggtgcttttttgtgaacctgcaggaggcatcaaataaaacgaaaggctcagtcgaaagactgggcctttcgttttatctgttgtttgtcggtgaacgctctcctgagtaggacaaattctagagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatcc

SEQ ID NO: 739 - protein, 1104 aa, unidentified; identical to SEQ ID NO: 587
  source 1..1104: note = rAPOBEC1-nMG34-1-UGI (PBS)

SEQ ID NO: 740 - protein, 1723 aa, unidentified
  source 1..1723: note = rAPOBEC1-nSpCas9-UGI (PBS)
MGSSHHHHHHMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESAMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 741 - DNA, 4308 bp, Homo sapiens
  source 1..4308: mol_type = genomic DNA; note = plasmid, prepared by Twist, that contains the A1CF gene, a cofactor for APOBEC activity on RNA
ccgaaacaagcgctcatgagtaatacgactcactataggggaattgtgagcggataacaattcccctctaggatccgaaataattttgtttaactttaagaaggagatatacatatgggcagcagtcatcatcatcaccatcacatggagagtaatcacaaatcaggtgatggattaagtggcacacaaaaggaagctgccttacgtgcgctggtccagcgcacgggatatagcttagtccaagaaaacgggcaacgtaagtatggtggtccgccgccgggatgggacgcggcaccgccggagagaggctgtgagatctttattggtaagttaccgcgggatttatttgaggacgagttaatacccctttgtgaaaagatcggtaagatctacgaaatgcgcatgatgatggatttcaacgggaataatcgcgggtatgctttcgtcaccttttcaaacaaggtcgaggccaagaatgccatcaagcaactcaacaactatgagatccgcaatgggagattattaggggtttgcgcatcagtcgacaactgtagattgtttgtaggcggaatcccaaagacaaagaaacgcgaggagatcctgagtgaaatgaagaaagttaccgagggagttgtcgacgtaatcgtttatccgtctgctgccgacaagacaaagaatcgcggtttcgcatttgttgagtacgagtctcaccgagccgccgcgatggcacggcgtaagttactgcctggtcgaatccaattatggggtcatggcatcgctgtggattgggccgagcctgaagttgaagtagacgaggacacgatgtcttctgtcaaaatcctgtacgtgcgcaacttaatgctgtcaactagtgaggaaatgattgagaaagaattcaataacattaagcctggggcggtcgagagagtcaagaaaatccgtgattacgctttcgtgcacttctccaatagagaggatgcagttgaggcgatgaaagcgttaaatggaaaggttctcgacggcagtccaatcgaagtgactctggcgaagccggtggacaaggactcttacgtgcgatacacacgtgggacaggcggccgtggcacgatgcttcaaggcgagtatacatactcgctgggccaagtatatgacccgactaccacgtacctgggagctccagtattctacgctccgcaaacctatgctgcgatcccaagcttacatttcccggctaccaagggccacttgagtaaccgagctatcatccgcgcgccgtcagtccgtgagatatacatgaacgtgccagtaggcgctgctggcgtgagaggattaggtggtcgaggatatcttgcctatacaggtcttggacgtgggtaccaagtgaagggcgataagcgcgaagataagttatacgacatcctgccaggcatggagctgacacccatgaaccctgttacgctcaagccccagggcataaagctcgctccacagatccttgaagagatttgccagaagaacaactggggccaacctgtctatcaactgcattctgcaatcggacaagaccaacggcagttgttcctgtacaaaatcaccattccagccctggcgagtcaaaatcctgccatacaccctttcacaccaccgaagctgagcgcctttgtggacgaggcaaagacgtacgccgctgagtatacattgcaaacactgggcattcccacggacggtggagacggcacaatggcaactgcagctgcggctgcaactgcgttccctggctatgctgtgccgaatgcaacagcccctgtgtccgccgcacaactgaaacaagcagtcacgttagggcaagacttagcagcttataccacttacgaagtttaccccactttcgctgtaacagcgcgaggggatgggtacggcaccttttgactcgagcaccaccaccaccaccactgagatccggctgctaacaaagcccgaaaggaagctgagttggctgctgccaccgctgagcaataactagcataaccccttggggcctctaaacgggtcttgaggggttttttgcttcccttcctttctcgccaaggctaggtggaggctcagtgatgataagtctgcgatggtggatgcatgtgtcatggtcatagctgtttcctgtgtgaaattgttatccgctcagagggcacaatcctattccgcgctatccgacaatctccaagacattaggtggagttcagttcggcgtatggcatatgtcgctggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctctattcaacaaagccgccgtcccgtcaagtcagcgtaaatgggtagggggcttcaaatcgtcctcgtgataccaattcggagcctgcttttttgtacaaacttgttgataatggcaattcaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccagatacctgaaacaaaacccatcgtacggccaaggaagtctccaataactgtgatccaccacaagcgccagggttttcccagtcacgacgttgtaaaacgacggccagtcatgcataatccgcacgcatctggaataaggaagtgccattccgcctgacct

SEQ ID NO: 742 - RNA, 55 nt, unidentified
  source 1..55: mol_type = unassigned RNA; note = RNA Sequence used to test CDAs for RNA activity. From Wolfe et. al. NAR Cancer, 2020, Vol. 2, No. 4
ggatatatgatacaatttgatcagtatattaaagatagttatgatttacatgatt

SEQ ID NO: 743 - DNA, 35 bp, synthetic construct
  source 1..35: mol_type = other DNA; note = Labelled primer for poisoned primer extension assay used to test CDAs for RNA activity. From Wolfe et. al. NAR Cancer, 2020, Vol. 2, No. 4. 5' FAM Label
aatcatgtaaatcataactatctttaatatactga

SEQ ID NO: 744 - protein, 275 aa, unidentified
  source 1..275: note = MG139-22
MPAPTHASLKATLQPKRAPCPNCFATPPQILSVPQTIQPVSKTQPIKKNLTYKEITGGNIQTTTLRASLNGEFLGKFNNVTRSMAGDDLKIATGILDWMKTNGYRIGDKDKPHAEDYLIYWMSNNQDIWKKQKPDTGMNLLSMAMDKTPCIVCARNLVTFKNKFGLTLRIKAGFHFELTRRRGKPVKPYGVDYLEEQKVPIRSWPLERLSVKLKGKAKPTKTMRKRFKISAGAFALDKMVKAITRDGKLDNAIGWKTVGYSRSQSSDTESGRGWK

SEQ ID NO: 745 - protein, 309 aa, unidentified
  source 1..309: note = MG139-23
MVGNRVAHRMAMADRNNANAELAPTAQVLSAGGAISGDNQKTIGTSAIRASDKPAPNSSALSKPFMKLMVSRDGGPVCGIRHTPSGLTQVKFPSSGRRAMAADRRLLKLHEALRRCSAPPNRVVTMVARVTPALAVGIRDLPALDRGARISGGRVLPVWMDGAGTLEIVAWNTGEASDLRRYGNRSHAEAQFFEFMRDREFKSVDIEISHSPCTACADMLAGLLKSMKAKGTTVSRGPTRRVGQRVYVGAAIETPPAIPATLRWGALFETPPQATTPQSLRELHAVGWHMAAPRTAIPNDAGTPGITLL

SEQ ID NO: 746 - protein, 210 aa, unidentified
  source 1..210: note = MG139-24
MAADRRLLKLHEALRRCSAPPNRVVTMVARVTPALGVGIRDLPALDRGAGIPGGRVLPVWMDGAGTLEIVAWNTGEASDLRRYGNRSHAEAQFFEFMRGREFKSVDIEISHSPCTACADMLAGLLKSMKAKGTTVSRAPNRRVGQRIYVGSAIETPPTTPATLRWGALFETPPQATTPQSLRALHDVGWHMAAPRTAIPNDAGTPAITLL

SEQ ID NO: 747 - protein, 210 aa, unidentified
  source 1..210: note = MG139-25
MAADRRLLRLQEALRRCSAQPANRVVTMVARVTPAPGVGIRDLPALDPGAGIAGGTVLPTWIAGGALEIVTWNTGEASDLRRYGNRSHAEAQFYEFMRDRDFTSIEIEISHSPCTACADMLAGLLNSMKARAASVLRGPNRRVGKRILVGSATDTARPIPATLRWGTLFETPPQATTPQSLRQLQAAGWRMAAPRTAIPNDAGTPAITLL

SEQ ID NO: 748 - protein, 210 aa, unidentified
  source 1..210: note = MG139-26
MAVHHRLEMLSAAMRRADVPAGRTVVMAARLSPAVGIGTRDLRPLDDGARVGGGRILPISITQPNALEVVTWNTGEASDMRKVGNRSHAEAQFFEFIRDRTFDSIEIEISHSPCTACIDMLAGWLRKRMESGTTFSKPTIRKVGNRTYVGSPGRNLPNVPAVIRWGVLYDMPPQATTWQYLSDLHKAGWQLAAPGNALPGGTGSTPVHLL

SEQ ID NO: 749 - protein, 211 aa, unidentified
  source 1..211: note = MG139-27
MADRRLPLLNRLEQVFPTRPAGRTVVLGARLTAPGPIAVGTRDLRPLEAGSPIPLAGRVAVAQRPPRPTIEVMTWNTGESRDLRYYGTLTHAERQLYECVREIAVDSVEIELSHSPCSACADILVSWLSGINAGVPAAQGPSIGMLNGRKVVRPATPGRIAARLAWAKLYDSPPQATTWAALDALHAAGWQLAAPRDALPPGEGLAPVALL

SEQ ID NO: 750 - protein, 236 aa, unidentified
  source 1..236: note = MG139-28
MLNLLSLITCFYTLKLQLREDFSREMALTEEEFQTCFAHAAQYGNGENWPHQTILFYSLSINGNLNIAFRRVDNTPQIEHAEITMIRQIEEHIQGDSEVNHISLKVYSSYSPCNSDGSAGAKAYCADALCKFQSDLKEKSIKCEIEIRFSSFYMAHDATSESCSRNRNGLIMLIRNRIQLEVFNGEQNWKEFLRDIGKQGDELNRWVELTRVEERITREQNDVSIRDDLINQEVRE

SEQ ID NO: 751 - protein, 176 aa, unidentified
  source 1..176: note = MG139-29
MTDHDLECFLFSGTYRDTSIPWPHKTVMVYCLTINGTPHDYQVIHSDHQNGHAEVKFINQVEISPEATEIYIEMFISYSPCDNCAKALIGWIEKLGKQGKTVSIAIKSSTFYLNETHGLISLGQVNGITFDVFCGEEAWETFFQCIRRTDFTKYKKRIRKRKDREDVDDTKLQGII

SEQ ID NO: 752 - protein, 231 aa, unidentified
  source 1..231: note = MG139-30
MAEGSTNFMKKLLTTGIIGTDWPKTAYLIVVIKNMSGKVIWKKNYRTLPRQDSSNQHHTESQMLKDQEFKNFIEKLYSSDETKEVDSILTSNYSPCKECADDLIKFYEDKESPVRKLTIRFAHPYQTKKDKQRHLDGLKDLHRVGITLEAMTEESWRDTMMIDKSWFDAMTDAKSSFEEMMNEEHWFDKVMKLFRLDPDSVRKRDVATGGKLATLLVKTPRLKDLSTDSKL

SEQ ID NO: 753 - protein, 267 aa, unidentified
  source 1..267: note = MG139-31
MLEKKDKNRFYKVDSQDTLTVVAVTKVTLESSGKTDSSTSFISTSFISRTNKDHKHAELLVIEETKKWLEETKKWLEEQTLTEQATTVRLTTMATKSPCSKCRPEIKKMLEEMKKKYNIVKYTLRISDFYHETINGKHEFDEDAAGILRVWKLKIEDLGVDFTLEAISVCDELRDHTPRLKKCDEHKTTEIPPTQCSKCKKLAEKTISDRSKKDLKIKGLLSQSIINEYYPQESRLTVDERTCTATASSSAQEQSSHHLYSPPSNTQ

SEQ ID NO: 754 - protein, 186 aa, unidentified
  source 1..186: note = MG139-32
MAWRQQNQNCAWVAGEAPYVFANEYTANFISGFRTVLIAKVEGEGVGNQPFGKFFNDADGHAEANFLEALRANDWVFDAGYQEIVVSINNSPCRQCCVLFKQFMEDILLRFPNTRLVIETANIYHPNDEIDQGCLRAISRLPGIRVEMWNVALENAQNRGPQVDQQKELARINKSLRTANVVRRMP

SEQ ID NO: 755 - protein, 225 aa, unidentified
  source 1..225: note = MG139-33
MTDTYILRWKDLFRPGTNPPVGSEAFARAPQGTTALLLVDRELTGDFKSVGSQHAEHRLLQSEQWKSALQTAAAGGVAARSEPLTIAVVINRSPCHFRAVERGHPVFLSRPAQEYFEAALAQVPGEALNEPSCGCSFKLASALVEFTKQHAVTGVKFLLACTGLYWPDDKPTVEHQGMTKKSDLAWLQLAGWDVRALEVDGNLTDRGRELIAELKAIEPWVGRRP

SEQ ID NO: 756 - protein, 201 aa, unidentified
  source 1..201: note = MG139-34
MKVKWEDIAKYYGWDINEHKHELTTALNTTHAKIACNWIDRFPKAYSSGEHAEAKLLNEEFWQKTVPSAMQASIGSGMQALVTLIINRSPCSSCCGKLVDALDTLKRKHPFVAEENSFFLLAMRGKYKSTTDQDFASLVDAGWSLGTLEVNVEKYTDPKSKEGLSSAGIALQTALTERKVFVDGHPQRIQNISGSYWALGH

SEQ ID NO: 757 - protein, 194 aa, unidentified
  source 1..194: note = MG139-35
MTAELNWNDLVEYFGDDLAAHRVRLSHAGWNTYGLLASRFIENDTLGVVNGEGEHAERKLVGSALWTQQLDQALAAWHPNSSPMLVLLAINRSPCADCAHLLADALHRIHNKYPLTAEKHVFLLASLGYYHSNKDEPRAPGALPKNFTTERGLRALRDAGWRLCTLSFDGQLTRRGKEFGAQLQRMSGRRSWAD

SEQ ID NO: 758 - protein, 188 aa, unidentified
  source 1..188: note = MG139-36
MNGILNWNDAVDYFGNELEPHRKELCEASRATYGLLACRSTQGGTTRVVNADGEHAERKLIMSDIWAKDLDSALSTWDPRSTPMLILVLLNRSPCSDCSHLLAGALHQYNDRYALTTEKQHFILGSLGYYHSNKPPDEGKGQLPKTFSTDRGMRAMIDAGWKLCVIDFGPGLTRRGHELHTYLKGLTR

SEQ ID NO: 759 - protein, 163 aa, unidentified
  source 1..163: note = MG139-37
MNSDRIYLNMCNELAKFSKCQYTNVACMMVNENGRIVASGVNGTTSGSENCCDLKFDSRDEHVKFADEEEIHAEMNAILDLARSGYSPTELSIYTNISPCPNCLKHLLGLINTKGHKLTINKIIFLEQYHRTTDLDIIKMKNRAIKHGVYLKSIKEVVEEREL

SEQ ID NO: 760 - protein, 186 aa, unidentified
  source 1..186: note = MG139-38
MLSLNLCLSRLRGELGHIEFGATEDWCVTRFDSNDSTLEVYWSEANKPYYHTSSSQQGEGIFRPWGGHAEMQMIRDFEVTVNHYGSTPYLVEIFISRSPCSRSLAYNVAGHSYPVGCGRKILELVKQNPAVSVWKVVYDHVFSGSRNAPDVQATAQAELMINRLNQHPRVEALLWAEYHARLQQHA

SEQ ID NO: 761 - protein, 145 aa, unidentified
  source 1..145: note = MG139-39
MKAPNAFLLGGNGRPIPGKAGTLKGTTTGVSPNQGGGHAEEYFLMKLMAFADQFYLPSEIEIYISRIPCASTSMKWNFSFKGVHMSLPAGCGAKLYAVIKTLSMVNWYIAYGEGYTGQTQSSSLAWINRIDSLPNAEAGHISKFI

SEQ ID NO: 762 - protein, 215 aa, unidentified
  source 1..215: note = MG139-40
MYEARQRKEKVSRRIDAAGNGMTKQKKTIGIMQCLRSKVPDYDKKICYQTILYAELDGIPVGGNGIFMSTGPDAHAEVNLKQTLNKLGKNSGHLIIYLSSSPCSSTYCTRRGEGEGCQEKLEELKERGFQIEIHADHLYQPQELRQVESKNGFPSGFCSASSAMQSSVPIDFSRVPKFFMGYLEHSNTSVAQFSRIGRYSVPTDCKSVGTEYKDL

SEQ ID NO: 763 - protein, 419 aa, unidentified
  source 1..419: note = MG139-41
MQTHHSKNKIPVSDNDNQNNKLQSVHFKDNRPESTTQLKVQQMANNAVVDAPIQRRTNNTGMPDNLKSGIEKLSGLDMSDVKVHYNSNQPAQFRAHAFAQGNQIHLASGQEKHLPHEAWHVVQQKQGRVKSTMQMRGTINVNDDVVLEKEADVMGNKALQMMYTSDQSESKVEVTNFGYSRNKRNVSTYLTKSRDNQKIIQRLRKKMRVSRAVYRKRLRSTVYLWSEFVSNLTGATTKLGLFQTSSTSHAEENLIQRINNLNLRDGTLTIHLSTSPCSSSPSHRTRCDGKTGCQERLNGLKSARNIKVEVLADHLYQPKIVAAKERKAKKGVGDTSNRGATKARFRIRFSRLPKAFHSHKRITNEDVAQFKTIEHPDDSLKLLGIEEIYIHEEKGERIIEVQGDFDKEQIDGIDAESSE

SEQ ID NO: 764 - protein, 376 aa, unidentified
  source 1..376: note = MG139-42
MRLTENVKEIYKAMYNHSHVCRPGCSCRQPALTSTENLVLPEVKFPGKAGIAPYAARNKGGTPVTQARVVILLNDRLPAFTIQTTILGKTPHITSGIGGLGGARIPIQIRGKRQYISLPSRGERGNGGVLFLPEAGKNMIHLLTWNVGSMSLSRYGGNETHAETQFLNWIKAHLKQYPQFLNRIRAIQIFINNSPCGNCTYDLCAFARRYNLGSKIKITWKKNYNKGTDSTANFQKLKQCGIVAVSPTQSELLAEIKPQLKNLKLAKQQQHTYILDKRVHSNKLQAVNRRAERLMTNSSKPASMLSRVFASPHNYTRVKQLFQGIIDQGNYRPRPDGGYEAVRTFKFPTGWSYGKPVNRLKAIIDQKGNWHYYPVP

SEQ ID NO: 765 - protein, 184 aa, unidentified
  source 1..184: note = MG139-43
MILHWEQLVLHYGSTLNLHRPRFEQAGQTTYGLLCCRYSPTEDELGYSAGDHAEANLLRTALWTAHLPSALRSWTPHDSCITVTLAINRSPCRNCAALLVSVLSALYRNFPARGPRNRFILAAKGAYEDAEMTTRTTQNDLRRLHDAGWELCVLQVGPTLSARGRILLEGIERVAGRGFVRLHG

SEQ ID NO: 766 - protein, 200 aa, unidentified
  source 1..200: note = MG139-44
MNELDFSVNLHPENAAMILHWEQLMLHYGPTMGAHRPRFEAAGQTTYGLLCCRYSPMEDQLGYSSGAHAEAHLLRSAVWTTHIPNALRQWTPHDSPIIVTLALNRSPCQNCTALLIDALSALYRDFPDRGPRNRFILAAKGAYEDAGMVTCTTQNDLIRLRDAGWELCVLQVGPNLSARGQILLEGIERVAGRGFVRLHG

SEQ ID NO: 767 - protein, 207 aa, unidentified
  source 1..207: note = MG139-45
MLLHWRQLTNYYGDELNAHLGHFHTPGQTTYGLLCCRFAQEHTRLMASQGEHSEERLLQSLLWRQIERTVQAWYSFNTDERAKAVVTLVLNRSPCHSRCVPALFDALNHLQYNFSKRFFDHWRFILACRGAYQGKVTDAGFYEHSTTTRDLQRLEDAGWQVCVLQTTTPVGNTFDLGEGLPPGGQALLQGLMNVKNVSRPSLIRLDG

SEQ ID NO: 768 - protein, 198 aa, unidentified
  source 1..198: note = MG139-46
MILHWRQLELFYGPDVNRHRAALSQAGQTSYALLMCNWTPSGSRRMASSSGDHAEQRLLQDSIWHIELDAAFQQWTPQLNDPIVVTIAINRSPCASCADRLSDALHQLHYRYAARFPHMRFILASKGYYQGDFVGTGAGGGISRDRVTTGRGMARLKEAGWTNCVLQFGDRLSARGEELLEFLEPDLRRRHTPVRLSS

SEQ ID NO: 769 - protein, 132 aa, unidentified
  source 1..132: note = MG139-47
MQSKLWTEQLPAALDAWTPGDAPIVVLLAINRSPCADCASVLASALHSLNDRFALRCEQQHFILASLGYYQGTGFMRDESAPHLRSIPSRAVTTHRSLQALHEAGWKHCVLDFGRGLTRRGEELYEYLRFNA

SEQ ID NO: 770 - protein, 197 aa, unidentified
  source 1..197: note = MG139-48
MGDLSARAQHFHSMYAFDNNMSSKLMVEVEGKIRSSEHTYGSGTLVHVEDMLLHQLDVWWGYAEIPANAKIVLYGNWSPCKHCISDTIPRAFAKMKIEEKNLRLRFRFNHYYTQENWQRAGKQIRQEGGGRFFWANAEEAENAYLQLAAPYGKFATKNISTTEAVMSSTSPRVAFIQGLNRSRSITTWSEVWRDKIF

SEQ ID NO: 771 - protein, 198 aa, unidentified
  source 1..198: note = MG139-49
MGQTSKYAEGLLDNFAYDYDMSCQLAVQYDEGKFKTSRFTYGSGPLVHVEDMLLHQLDEWWGYANIPPGSKIVLFANWSPCKHCIQNTIPNALNKMNVTDNNLRIRFRFNKYYTEQAWTGCGKTVRKEGGGHYFWESQEAADSAYDTLASIYGNCGLKNLSTTTQVITSVSPRVAFIRGQSKSRTLTTWHETWRGKIS

SEQ ID NO: 772 - protein, 362 aa, unidentified
  source 1..362: note = MG139-50
MYHQSHVCRPGCLCRQQAATSPDSVHQEVKFPGKAGITPYAATNKAGAPVTQARIVILLNDRLPAFAIQTIILGKTPHITSGIGGLGGARVPIQTRGRRQFVSIPSKGARGNGGVLFLPESGRNVIHLLTWNVGRLSLSRNVGNETHAETQFLNWIRAHLQQYPKFLKRIRAIQILINNSPCGYCTADLCAFATKHHLGSKLKISWKRNYNKGTDSTANLQKLRQCGIVAISPGQSELLAEIKPQLKNLKLAKQQQHTYLLDKRVHSNKPQAVNRRAERLMTNSLKPTSLLSRVFASPHNYARVKQLFQGTINQGNYRQRPDGSYEAIRSFRFPTGWSYGKPVNRLKAIIDQKGNWHYYPVP

SEQ ID NO: 773 - protein, 342 aa, unidentified
  source 1..342: note = MG139-51
MKKTTDKGFEYKTPDHLSDPIIKTGLATMGGQHGSKFGLTDPDSQGTTLLAKINGYFFGFFQAGDEWGKSLGIKNIERKTDKETVHAEEYFLAALRDTWDFLLDDGIIKKDESPSITLKITKTPCSGCAPQLVDFVSKEKDCNIRIKAAQLWGHRSNQFPHNVTALNELGKAGVTVIPWNLLSKLGKSRKSLTKHELADLSDKKFDEEDVKRLENEYNTLRESLGLEDDDLFQKRLKDYKGKGVSKETMIAILKETAPRIIESTTLKLEKMEFQLTGVNNALDKAKEPSTRKSPRKTVQAETAKSRARKINELSTKKQKKEENAEALKKTKELYQDMVVDEK

SEQ ID NO: 774 - protein, 221 aa, unidentified
  source 1..221: note = MG139-52
MAEGGQDSAFEFMKTLLETGIDDCWPNFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 775 - protein, 304 aa, unidentified
  source 1..304: note = MG139-53
MAEGGQDLKFDFEFMKILLETGIDNCWPRFTNLIVDISDGELTWKRIYQTSDSHTESQMLDDKEFKAKFKVEEDKADKITDTEKTKKTDKAEKVDKTEMVIKAEKVGKAEKVDKTEKVDKTEKVDKTEKVDKTEKVDKTEKVDKTEKIDKPEEVDIILTSNYSPCRECAVKLIDFYEEKKSLIRNFTIRFSRLYRITEQENKDGLKDLNRAGNSAGITLEAMTEKSWFNVLMTDNSWLDSMSTQQKSSFEKMMNEKDCFDKVMKLFGLVPNKVKQRDAATSKDLTDLLAQDKKTQDSRLKQIIS

SEQ ID NO: 776 - protein, 164 aa, unidentified
  source 1..164: note = MG139-54
MPPAGSRQDLPKRTYLIAVVKTDNGEEIYNERFKNIPNGEHAEERMLNDEDFLHAVVDHHNVKIILTSNYSPCSKCARKLISFYKKRERKIRKFIIQFPFLFKKQEEENRSGLRSLNEVGVTLRAMNADSWFKVGIDFMDVEDKERITERDKKTAYKLKQVLFT

SEQ ID NO: 777 - protein, 223 aa, unidentified
  source 1..223: note = MG139-55
MAEGGQDLAFMKTLLQTGIDDCWPHFTNLFVVLKTEDGEVIFKKKYQTSYTYGHTEIQLLRDKEFKDEVEKVKADKTKKVFIILTSNYSPCGECADKLKEFYELEIKKSLIQGFTIRFSRLYRINKQDNKNGLKDLDIKGITLEAMTEKSWFDVLMTEKSWPDSMAVGKSSIEKMMKEKDWFDEVMKLFGLDPNKVRKRDAATSKGLDELAMEALADKVEKNL

SEQ ID NO: 778 - protein, 172 aa, unidentified
  source 1..172: note = MG139-56
MDDELECFLFSGNYGNLNANWPHRTVMVFRSTINGTPGVYQVIHNDPQNDHAEIIFINQVNIPPEATEIEIEMFISYSPCNTCADALIVWINNLTMQVSIAIKFFSFYKNETRGLILLSQVDGITLDVFRGEEAWENFFQCIRRTDFTKYKKRIRKRKDREDVDDTKLQGII

SEQ ID NO: 779 - protein, 186 aa, unidentified
  source 1..186: note = MG139-57
MFYFFLEQLDDDLKECFLFCGTYGDNVNFKWPRKTVMVYRLKINEELGDYKVIHNDSTNHAEIRFINEVRNSITKQHTKIDIEMFISYSPCDACAQALEGWITELRGEIPGRNVSIAIKFSNFYLEERAGLNALHKAKITLGVFNQNVWGEFFQLIKKKPDGEFQKLIDQRAARETIDASKLKGII

SEQ ID NO: 780 - protein, 178 aa, unidentified
  source 1..178: note = MG139-58
MTDEDLNECFLFSATYGDQNDDWPHRTVMVYRLTINGELGDYKVIHSDGANHAEIHFIDEVSNSITQLHTEIKIEMFISYSPCDDCADALIDWITGLMEEVPGRNVSIAIKFSAFYLNERAGLIHLHQFPGITLGVFNTEVWTEFFQLINRNLYEFQELINQRADRETIDANMLQGII

SEQ ID NO: 781 - protein, 193 aa, unidentified
  source 1..193: note = MG139-59
MFLSCFILILFLDQLDVDLKECFLSNGIYGVPGGGWPNRTVMVYRLKTNKKWGDCKVIRNNPANHAEIIFIDEVRNSITEKHTKIKIKMFISYSPCDKCAIQLIHWIKKLRKKKTKFSIAIKFSNFYLKHRDGLRSLHKFDKTLGVFNTEVWTEFFQLIHKNLNKFQELIDQRAARETEDARILEGIISLKRI

SEQ ID NO: 782 - protein, 236 aa, unidentified
  source 1..236: note = MG139-60
MGRNIPHWVSRAVKRLQRERAGPTDRLLLGRPMRCVPQAWADRPARALALRRMLLPGDDGRGPAPRWLRQMAAGALGAVPRKVHLGAAAAAVDAAQTAALAPGSVLVAHVPRRGLEGATHCEARIFDRLSREPAHALEGLSPLVFYSVKCPCQDCAEKIARFATRHPSVSVEIAYEQQWVPEAYADSHGGGYSDASAVATMRAAGVSVATTEQLIWCDLVDTIEGFGVERGVSLGG

SEQ ID NO: 783 - protein, 205 aa, unidentified
  source 1..205: note = MG139-61
MGEKTRYVFSDVETRLHLENKHPESTIMGAADVFHEGSPGGGRPLIGVYSSDTRLHAEDHLVIQLQGRYGREFFNIAEGSKVVMAMTWSPCKACVDGALTALCNHLKARRAFFKLKFLYWSTKAQRTKFRLSSSDNFFDTQAEARAKYREFMDRYPHTSHEVMDDDSRGMFLLTPRFQISPISEKPRTIGFKPFSEVEMASCMND

SEQ ID NO: 784 - protein, 427 aa, unidentified
  source 1..427: note = MG139-62
MSQYRYVSNGPRQHRAAAHHVSPGGVSKPAVMPLQLVPAKDPCCKGDADNVKPGIAPVQGIFYWADHPHEEVDDNDNENADGITALTKKGFQKKFLTYAHGKLLDLEDIRETDIQRVFTDAFNDGKAISLGNKGANLVDPLISWFRANIKEIRKNYTLIPRAGSITGKKRKHYNPKPVRGEATGVPRRVKMKLTREFSVAEGMLHAPIFSFGGENVTKYTHVEGNGTYSIGAYAVQGGGAHLLAGSKSGENFGGSPVLKMHAEEQQIAAFEDQVAQNAHGLRDAFATGQKVVLYLHISKSPCSKQCQGIFDTLLSKYPTLEIQLYLENLYKANKPDLMKAEAIKLKALMEKYPGRLAYKIVSTENAKTALSDPQHPMKKLGGLEDIIFQSIVSNDNNASLAGTRRKNFTELIDAGHFPPESFVDSLK

SEQ ID NO: 785 - protein, 433 aa, unidentified
  source 1..433: note = MG139-63
MTLETLRSSKYKNIFYGKGKENFDQETVAYSIVVVNDGHREEFLTTSSSGDGHAEDSFLTQVQTLLRKFQIKKIEITIMLSKSPCWKCRENLEACFESLTKKGVTVIFVLRIADLYYGKDRCEEPVVENLALWFRHIITNNIVSEYDIQPISVTTELHEYSPRLIDIAEWNATVKKRSTADRTISDTVNNIKRKIEDNLEPTPLSISNLANVIKKLVAKEKQLFYKSTSTNRHTQIFVAIAQVQLYASNTVGRTKKKEFQVIIKQTEKAGCCHLHFEGLLTERLSNEDKYEAPASWTRVSRKILLALTHFPCGNCVKKITTVIRELKPRLLVLRVANINLDERAFISDWLYQRCREGLDIRLEAISVVTELGTVYCKRGATDDEAADWKRVFKEGRPGLDVMIIDEVRRINTEISDKILFEDEAERLSKIQIN

SEQ ID NO: 786 - protein, 315 aa, unidentified; identical to SEQ ID NO: 644
  source 1..315: note = MG139-64

SEQ ID NO: 787 - protein, 216 aa, unidentified
  source 1..216: note = MG139-65
MYEARQNKEKVSRTLFKSLNSVCQNHKAYQTEFISKPIKSSICKNNHTFQFMTDAYNANPGSFDNLMGSFPYKSIKQALRYRTIAEAKVNGIELGMSFSNKAYGDSDHAEDAIIDTMEIIMDLYFSQPQPSKFTEIINSIRNTPTSVLEISISASPCERCRQRIKEFRDLYGFQVRIIYHHLYKDPNGATKSSNEGMQELSRAGIPSIQDKELIQR

SEQ ID NO: 788 - protein, 215 aa, unidentified; identical to SEQ ID NO: 762
  source 1..215: note = MG139-66

SEQ ID NO: 789 - protein, 158 aa, unidentified
  source 1..158: note = MG139-67
MINNDQIWINITNELAKFSKCQFTQVACIAVNDSGRIKATGVNGTPSGMTNCCDVKFEKREDHKQWSDDHELHAEMNMIEDLARSGRCPSKMSIYINISPCKNCLKHLIGLTKRKGSDKVEIDKIVFGKVYHRLTDDDIINMKSYCAEADVILKQVGE

SEQ ID NO: 790 - protein, 163 aa, unidentified; identical to SEQ ID NO: 759
  source 1..163: note = MG139-68

SEQ ID NO: 791 - protein, 235 aa, unidentified
  source 1..235: note = MG139-69
MAGRFDSRLTLLQAVPRGSVPAGRVVVLAARIMASCAIPRGSLVVPAVDESVRVRASAANPAPDAASGGLVRAGTHDQSNVLELACWNIGEPQSLNFTGNRTHAERQMVEYLKAMEAAAPGFFGSIVSIEIDINRSPCTACADSLCGLLNRIRAARPAVAAPVRMMGGRKVFSSPSAAPVPATLRWQALHAGGPQATNWAALLELSRAGWRLLSPADARPGPGSVHQGLVTVGNL

SEQ ID NO: 792 - protein, 231 aa, unidentified
  source 1..231: note = MG139-70
MKHWHIFKQVFKKAFCSVKTYLLTHLLISLDEVCNPRYAGGTVLPPVLTKYKLSNMIDPSKTKTYLYVPAPPHGEERVYISAGETHAEDYMLAAAITPPEFWITNSPCPVCARKLMAAYADSLTKAEINIRRFYKPPPGNARAISKATDCLAKMIYQGFKLYDWDWVAFYNEYLRGGNEKCIDVLKKAANNEEKFNILRAQYVELQKVLAEAKRRSRNLDWIRNIATKCQP

SEQ ID NO: 793 - protein, 183 aa, unidentified
  source 1..183: note = MG139-71
MILHWEQMVLHYGPEIATHRPKFEAAGQTTYGLLCCRFAPDDKQLASRDGDHAEARLLQHQNWTEHIPRALEHWEPRDSPIVVVLAINRSPCRNCSALLVTALGALHRRFPVACDQNRFILASRGIYEDARMQQATTRNDLIRLKDAGWELCVLQTGPTLPPVGNHLLDGIQDVAGRGFVRLG

SEQ ID NO: 794 - protein, 276 aa, unidentified
  source 1..276: note = MG139-72
MWRFNANHGFHSLRCLLMCPGYFGGDVLTFSLWDSVHRKLALTDIRNMARVTYEEVRDKFIIRSQYGLWHPDRWPYGKKATIALCRVTGEDGNSLLPDDHQARIYRNLRNNHAEILLLRDLTQLLDGNDANINIEIFMNYSPCSNCATEILGFKQTMEGGGGIIKISITFANFYLTHVYANNNKTTADANKNGLLQLHKAAVGIKLLKGDKWNSLLQTQYFVDLHGNEETLLLDRAQSVQRRSRESTDMIFLNEITATEGIAEEILADLALQQLGL

SEQ ID NO: 795 - protein, 167 aa, unidentified
  source 1..167: note = MG139-73
MFSGTYGNLNADWPDKTVMVYRLTIDNGTPGVYQVIRNDRQNGHAEIKFINQVEISPEATEIKIEMFISYSPCNKCANELIDWIKNLREQGKTVSIAIKFSTFYKDETDGLISLVEEGEIILEVFRGEEAWKTFFECIGRNFTPFVEHIRQRKEREDVDHNKLKGII

SEQ ID NO: 796 - protein, 150 aa, unidentified
  source 1..150: note = MG139-74-1
MVYRLTINGELGDYKVIHSDGANHAEIHFIDEISNSITQLHTEIKIEMFISYSPCDDCADALIDWITGLMEEVPGRNVSIAIKFSAFYLNERAGLIHLHQFPGITLGVFNTEVWTEFFQLINRNLYEFQELINQRADRETIDANMLQGII

SEQ ID NO: 797 - protein, 178 aa, unidentified
  source 1..178: note = MG139-74-2
MTDEDLNECFLFSATYGDQNDDWPHRTVMVYRLTINGELGDYKVIHSDGANHAEIHFIDEISNSITQLHTEIKIEMFISYSPCDDCADALIDWITGLMEEVPGRNVSIAIKFSAFYLNERAGLIHLHQFPGITLGVFNTEVWTEFFQLINRNLYEFQELINQRADRETIDANMLQGII

SEQ ID NO: 798 - protein, 186 aa, unidentified; identical to SEQ ID NO: 779
  source 1..186: note = MG139-75

SEQ ID NO: 799 - protein, 194 aa, unidentified
  source 1..194: note = MG139-76
MFLSCFILILFLDQLDVDLKECFLSNGIYGVPGGGWPNRTVMVYRLKTNKKWGDCKVIRNNPANHAEIIFIDEVRNSITEKHTKIKIKMFISYSPCDECAMQLIHWIKKLREKKTKFSIAIKFSNFYLKHRDGLRSLHKFEGITLGVFNTEVWTEFFQLIHKNLNKFQELINQRAARETEDARILEGIISLKRI

SEQ ID NO: 800 - protein, 170 aa, unidentified
  source 1..170: note = MG139-77-1
MSNGIYGVPSGDWPNRTVMVYRLKTNKKWGDCKVIRNNPANHAEIIFIDEVRNSITEKHTKIKIKMFISYSPCDECAMQLIHWIKKLREKKTKFSIAIKFSNFYLKHRDGLRSLHKFDKTLGVLNTEVWTEFFKLIHKNLNKFQELINQRADREKEDARILDGIISLKRI

SEQ ID NO: 801 - protein, 179 aa, unidentified
  source 1..179: note = MG139-77-2
MDVDLKECFLSNGIYGVPSGDWPNRTVMVYRLKTNKKWGDCKVIRNNPANHAEIIFIDEVRNSITEKHTKIKIKMFISYSPCDECAMQLIHWIKKLREKKTKFSIAIKFSNFYLKHRDGLRSLHKFDKTLGVLNTEVWTEFFKLIHKNLNKFQELINQRADREKEDARILDGIISLKRI

SEQ ID NO: 802 - protein, 208 aa, unidentified
  source 1..208: note = MG139-78
MAATKKQAPLNDEDLKMILRCGVPGSFWPHDTVTLCIVRTKDGRVLSRKSYKCSGGDASAHTEMQFLADMENSAELDTHFREILLSGNYSPCAGCADKLCQWIEKHHSNVSLTIQFAHLYNVYVHHDAKENAQGLRKMREGGIKLRALSAYDWLQFLLLDRGFAAKDDWIAKRKQADETNSSVLKEVLDSTGDGLELDETLKKLQRLS

SEQ ID NO: 803 - protein, 235 aa, unidentified
  source 1..235: note = MG139-79
MASQLDKEQIQLLLTTGVDRESWPHEAVVLCVLQKENNVVFRKVYENVPKSGSSDGVHAELVMLNDTAFQNHFKEGQKNIEIFLVSNYSPCGNCANKLGQFYDKNKKYLKTFTIRFSVAFRVNKEEQPIGLANLKAAGVILESMTQESWCDLLIWSLDRLPHGIREKVKVRDGREKERLDRALQEGRKALVQESHRKALPESRKSEMNRGMGNLSIQDGSSPKGAGKPGPSNERY

SEQ ID NO: 804 - protein, 227 aa, unidentified
  source 1..227: note = MG139-80
MASQLDKEQIQFLLLTTGVDRENWPHEAVVLCVLQKENNVVFRKVYKNVPKSGSSDGVHAEIVMLNDTAFQNHFKEGQKNIEIFLVSNYSPCGNCANKLGQFYDKNKKYLKTFTIRFSVAFRVNEEEQPIGLANLEAAGVILESMTQESWCDLLIWSLDRLPHGIREKVKVRDGREKQKLDEALQEGRKALQESRESEVNRGTGNLSIQDGSFPKDAGKPGPSNERY

SEQ ID NO: 805 - protein, 168 aa, unidentified
  source 1..168: note = MG139-81
MVLFDYAIDEEFLTTLLSTGLPDTDLPKRTYLIAVVKTDNGEEIYNERFKNIPNGEHAEERMLNDEDFLHAVVDHHNVKIILTSNYSPCSKCARKLISFYKKRERKIRKFIIQFPFLFKKQEEENRSGLRSLNEVGVTLRAMNADSWFKVGIDFMDVEDKENSDWCLG

SEQ ID NO: 806 - protein, 188 aa, unidentified
  source 1..188: note = MG139-82
MFHIFFCFLDDFLKDLLWPTGVYGENWPKRTYLIASIKANDGKDIFNERFKNKHRQHAEKVMLRDPQFLDVVKKNRDIEITLTSNYSPCSDCADNLKKFYEKYTDNINNFTIQFSFIYHIEKYKNKTALQNLSKAGITLRAMNVESWREVGLDLAFYLNATEREKVKKRDRITARNLKNVLSEPNQDG

SEQ ID NO: 807 - protein, 164 aa, unidentified; identical to SEQ ID NO: 776
  source 1..164: note = MG139-83

SEQ ID NO: 808 - protein, 203 aa, unidentified
  source 1..203: note = MG139-84
MFDYATDEFLKNLLWTGVPHTVWPKRTYLIAVVKTANGKEIFKKGFKNKPKDGHAEEVMFNDYDFRNTVAGDRYIEIILTLNYSPCSECAKKLKTFYESHKKKITKFIIQFSYLYYIQKEENQSGLRNLSNAGVTLQAMNANSWREVGIKFNSMKENDKEKITKRDNNTANKLNEVLSKKQNEQGQDTSVDELSSRFNKQMKF

SEQ ID NO: 809 - protein, 206 aa, unidentified
  source 1..206: note = MG139-85
MIIILFDCATDKFLESLLWTGVKGTVWPSHTYLITVVKDVKDGKIFNQRFENVPYKHAEEIMLDNIYFRNTVAGDRYIEIILTLNYSPCSKCAKKLQSFYESHKKKITKFIIQFSYLYYIQNKENQNGLRNLNEAGVTLQAMNPDSWDEVGIDLNVMKAKDRKRITERDKNTADELYRVLFPYKKEQVQDTSVDELSSRFNKQMKF

SEQ ID NO: 810 - protein, 201 aa, unidentified
  source 1..201: note = MG139-86
MFDYTTDKEFLRTLLWTGIEWPKRTYLIAVVKTAYGKEIFKKGFKNKPKDGHAEEIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPYKKEQVQDTSVDELSSRFNKQIKF

SEQ ID NO: 811 - protein, 201 aa, unidentified
  source 1..201: note = MG139-87
MFDYTTDKEFLRTLLWTGIEWPKRTYLIAVVKTAYGKEIFKKGFKNKPKDGHAEEIMLNDYYFRKTVAGDRYIEIILTLNYSPCSECAKILRTFYESHKKKITKFIIQFSQLYYIQKEENQNGLRNLYEAGVTLQAMNPHSWGKVGINLNATTEKDRGRITERDKKTAYQLYRVLSLYKKEQVQDTSVDELSSRFNKQIKF

SEQ ID NO: 812 - protein, 176 aa, unidentified
  source 1..176: note = MG139-88
MKDLLWPTGVYGENWPKRTYLIASIKANDGKDIFNERFKNKHRQHAEKVMLRDPQFLDVVKKNRDIEITLTSNYSPCSDCADNLKKFYEKYTDNINNFTIQFSFIYHIEKYKNKTALQNLSKAGITLRAMNVESWREVGLDLAFYLNATEREKVKKRDRITARNLKNVLSEPNQDG

SEQ ID NO: 813 - protein, 180 aa, unidentified
  source 1..180: note = MG139-89
MVLFDYAIDEEFLTTLLSTGLPDTDLPKRTYLIAVVKTDNGEEIYNERFKNIPNGEHAEERMLNDEDFLHAVVDHHNVKIILTSNYSPCSKCARKLISFYKKRERKIRKFIIQFPFLFKKQEEENRSGLRSLNEVGVTLRAMNADSWFKVGIDFMDVEDKERITERDKKTAYKLKQVLFT

SEQ ID NO: 814 - protein, 197 aa, unidentified
  source 1..197: note = MG139-90
MFDFYFCALTFLFCFLDDFLNDLLWTGVKGKNRPKRTYLIASIKDNDGKDIFNERFKNTPFGKHAEKTMLCDGDFRKAVAYHHNMEIVLTLNYSPCSSCADDLKLFYETYRNIGNLTIQFSFLYNIQEEENRSGLRNLSNAGVTLQAMNANLWREVGIDLESMASEDERRISGRDKNTGDMLYAVLYRYQNEQDQDT

SEQ ID NO: 815 - protein, 265 aa, unidentified
  source 1..265: note = MG139-91
MYIINSRIKRLVLLGTRMLQIVYCVFYLHSFLSGSVTFLEFDLRIYPYFYILMIILFSFFFVLFCFLDDFLNELLWTGVRDTKLPNRTYLIASIKSKDGEDIFNKRFKNEPFLKHAEAVMLCDDDFGDAVAVHHDIEITLTLNYSPCSSCACELKKFYEKNRNIRNPIIQFSFLYRIEEEKNQHGLRNLREAGITLQAMNANSWREVGIDLELMALEDKEIITERDEDQADMLNKVLSTYESEHDQDTSNDDELSSLFQSQLKFL

SEQ ID NO: 816 - protein, 215 aa, unidentified
  source 1..215: note = MG139-92
MAEGGNSKDVILKEWLSTGINSKYTGSEWTSVTHLVVYIKDNDGTGIYAKYFRNNKDNHAEINMIKHSEFEKMVRKGKVDITVNSNYSPCSDCASSLITFYGKYKEYINSFTIRFAFLYFINKTKNRDGLKNLKEAGIILEAMTEKSWFEVFMLFKFSSTLADQVRKKDEDTRATLSKLLNEVPETGQVAGAGEEPGIEELTQKTKTVEVTAKNT

SEQ ID NO: 817 - protein, 250 aa, unidentified
  source 1..250: note = MG139-93
MKGLIECLLFCVSAWSRILACREILTTGSGSNWPHSTALCCFIYKTYKNKKDGQNQIFQKIYQNEPQEQHAEEKMLAIEPDSDFISTIKDKNAVHDIVLVLSYSPCYSCANKLIVFYEKYKNPYSISSFKIRFSQLYKIYGRIPKEEKEKNKKGLKDMLLAGITLETMTDKHWFDLFSRMVFGVNPDSCRIRDNSMERKLDTLKKEAEAAAEVDVDTDADRASDADADTEEEEDLQTMMHTMVLTDEADG

SEQ ID NO: 818 - protein, 216 aa, unidentified
  source 1..216: note = MG139-94
MAELEESKDFIKNLITTGIRDTDWPKKTYLIVVGKNKTGKVIWKKKYQTLPNKFGSLPNENHTERQMLDDQEFEDQVETGEVRKIILTSNYSPCKECAKGLINFFQERTELELTIRFSHLYEERRVNHLEGLKDLDREERITLEAMTEKSWLDVLTNEEHFLDMVLTFMFDLNPCKVEQRDVATAKKLKKLLKSDSGFELGIVDKMRRMPFESDSD

SEQ ID NO: 819 - protein, 211 aa, unidentified
  source 1..211: note = MG139-95
MATTLEESKDFIENLFTTGIKGTVWPKKTYLIVVIKNRRGEVIFRKKYQTLPNRCGFLPNENHTERQMLDDQEFKECLETGEVCEIILTSNYSPCKDCAKDLKNFYEECTELRLTIQFSHPYETNDGKDHLKGLKNLDRAGITLEAMTDESRLDVLRNEEHLLDMVLKFMFDLDPRRVEERDVATKEKLKKLRRTDSEAERFAAKMKNLNL

SEQ ID NO: 820 - protein, 194 aa, unidentified
  source 1..194: note = MG139-96
MAEREDLNFIEILLKTGTDDCWPDDTYLIVLILNMIGEVIWKNKYQTSDEHPEIQMLKDDGFKDKVKKRKAGAAEKVTIILTSNHSPCYKCADELITFFNGRKSLKDKFIIQFSRPFRTDEELNQNGLRNLDMAGIILEGMTSKCWFSVMIQYMFDLEPDKVSKRDYDTRERLDELLADDSEDSEDDSEDSESD

SEQ ID NO: 821 - protein, 238 aa, unidentified
  source 1..238: note = MG139-97
MAEGGEDVPFVRALLDTGIDGYKPKFTNLIVFIKNTDGTVIWKDKYQTSESHVHAEIQMLIDKEFKDKVEKGKADKTEKVDIILTSNYSPCWECALELKKFYKGKKHLIRKFTIRFSRLYKREEYDNEICLRDLKSKGITLEAMTEESWFDVLMIQKPRFDSMKNAKYSFEEMMNEDDWFDKVMEHFYLDPVKVKKRDVDTRKKLEKLLRQVSSESSDSEAERLANDLKNLKVEGGSD

SEQ ID NO: 822 - protein, 238 aa, unidentified; identical to SEQ ID NO: 821
  source 1..238: note = MG139-98

SEQ ID NO: 823 - protein, 184 aa, unidentified
  source 1..184: note = MG139-99
MAFMKILLKTGIDGYWPKFTNLIVVIKTEDGEVIWTKTYQTSKSHVHTEIQMLTDKKFKDEVEKVKADKTKKVVIILTSNYSPCRECADKLKEFYEDKKSLIQGFTIRFSRLYRINEQDNKNGLKDLYIKGITLEAMTEKSWFDQVMKLFDLDPDKVRKRDADTSKGLKELEIEALADKVEKNL

SEQ ID NO: 824 - protein, 304 aa, unidentified
  source 1..304: note = MG139-100
MAEGGQDLKFDFEFMKILLETGIDNCWPRFTNLIVDISDGELTWKRIYQTSDSHTESQMLDDKEFKAKFKVEEDKADKITDTEKTKKTDKAEKVDKTEMVIKAEKVGKAEKVDKTEKVDKTEKVDKTEKVDKTEKVDKTEKVDQTEKIDKPEEVDIILTSNYSPCRECAVKLIDFYEEKKSLIRNFTIRFSRLYRITEQENKDGLKDLNSAGNSAGITLEAMTEKSWFNVLMTDKSWLDSMSTQQKSSFEKMMNEKDCFDKVMKLFGLVPNKVKQRDAATSKDLTDLLAQDKKTQDSRLKQIIS

SEQ ID NO: 825 - protein, 331 aa, unidentified
  source 1..331: note = MG139-101
MAEGGQDLKFDFEFMKILLETGIDNCWPRFTNLIVDISDGELTWKRIYQTSDSHTESQMLDDKEFKAKFKVEEDKADKITDTEKTKKTDKAEKVYKTEMVIKAEKVGKAEKVDKTEKVDKTEKVDKTEKVDKTEKVDKTEKVDKTENVDKTEKVDKTENVDKAEKIDKPEEVDIILTSNYSPCRECAVKLIDFYEEKKGLIRNFIIRFSRLYRITEQENKDGLKDLNRAGNSAGITLEAMTEKSWCDVLMTDKSWLDSMSTQQKSSFEKMMNEKDCFDKVMKLFGLVPNKVKQRDAATSKDLTDLLAQDKKTQDSRLKQIISSKTRHRHKK

SEQ ID NO: 826 - protein, 257 aa, unidentified
  source 1..257: note = MG139-102
MAEGGQDLAFEFMKILLKTGIGKCWPKFTNLIADIKTKDGEVTWRKKYQTSKSHKHAEFQMLNDKEFKDEIGKVKADKTKRTEKTNKTEKTNKTEKTEKVDIILTLNYSPCGECADELVEFYKDKRSLIRKFTIRFSRLFRINIQANIDGLKDLNSAGITLKAMTEKSWYDVLMPEESSGFEEVMELYDLDPVMIRKRDLDTRKTLQELLGKDQSDSSDESGSSHESGPSHESESSDSDAQLLVSDMEKLKFESDSD

SEQ ID NO: 827 - protein, 257 aa, unidentified
  source 1..257: note = MG139-103
MAEGGQDLAFEFMKILLKTGSGNCWPKSTKLIVDIKTKNGEITRRKKYQTSKSHKHAEFQMLNDKVFKDEIEKVKDDKTKKTEKTKTTDKTEKVDIILTLNYSPCSECADKLIEFYKDKRSLIRKFTIRFSRLFRINIQANIDGLKDLNSAGITLKAMTEKSWCDVLMPEESSSFEKVMKLYDLDPVMIRKRDLDTRKTLQELLGKDQSDSSDESGSSHESGPSHESESSDSDAQILVSDMEKINLKAILTDKSVYS

SEQ ID NO: 828 - protein, 165 aa, unidentified
  source 1..165: note = MG93-12
MRRETCLLYEIQWGTSHRRWRKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPGKKQRPRLLSVYNRQQCPRQEVSEVKVKLMGEGTRSNIPSNESVSNSFI

SEQ ID NO: 829 - protein, 137 aa, unidentified
  source 1..137: note = MG142-3
MRQFIFWGLLPYPSSPLHVACSRMIPSLHQYYSRTCLHAEQCFLYWFHEHMLDPAEDYQVTWYISWSPCSTCADEMASFLATHRNVSLTIFSARLYYFWNSAYQNGLRKLYQEGAQVKVMTFQGERWWEVRATKRLG

SEQ ID NO: 830 - protein, 227 aa, unidentified
  source 1..227: note = MG152-1
MWNTVLNHGYGYSELGGSLASETYLVCKMDGEPKPIIKGNNIEKHAEMQLVDDLKQMELLQKKVTVYINNSPCAACAKKLKDYLEENEGIHLTLYVTHLYNIRRMSCQLRVNALEKERHIYYCEEHEANYQGLKDLMSLGGNRCEIKAFTVDVWRELHEVMGLTTDDYQQRMKKYNTMIQDPTQDPKNKKNHDRSRKREDINIKNDLNHLKENVDPWNGIRKIFLKR

SEQ ID NO: 831 - protein, 222 aa, unidentified
  source 1..222: note = MG152-2
MSNIHLFFWGFFCIDKKENGNVIQHIYNTGLDHDDWSEAMDTFLVCKINGVHNPKIIRNSENHAEQLLIRHLRKKYKEKKMALKLTVYINNSPCSMCAKALENFLNKNKNVKLTFYVTNMYHIKRNSCFKARHFEHLNSIPKKSHKANSEGLRDLLRHKRCNIKAFNMGVWKELLNTVDVLPKLKTKLIGGYNRIQHANKRSRGYEDDLIKKDLMYLKSYKK

SEQ ID NO: 832 - protein, 249 aa, unidentified
  source 1..249: note = MG152-3
MAKGGVESGEELFENLDKSGNKEKLDTMWNTVLNHGYGYSELGGSLAKTTYLVCKIDGVPEPIIIGNDEGKHAEKQLVDILKEMTLLKNEVTVYINNSPCAACANEFKDYLEENEDIHLTLYVTHLYNIRRRSCQDKADTQNERHMKTIDKDEHVDNYKGLRDLMNLEDNRCKIEAFTEDVWRQLHEVMGLTEDCQQRMITYAETKITDPKNKEKNHDRSRKTEDINIKNDLIHLQKNVDPWHGIKKYY

SEQ ID NO: 833 - protein, 267 aa, unidentified
  source 1..267: note = MG152-4
MTDKFAPLPLIKMESVPSPGDRSTDSYQTDNSDEDDASDCDFESCERFSYTPYKVNDIIHKMWDTVLDHNNGYQQNLASSTYLVYKIEGMHKPGILKNDTMHAEKQLISIIQGNFTAPLKIIIYIYINNSPCAECATLLKKFMVDNQKIKMVLYIAHLYNIKRSSCVLRAALKKESRHVDCIPKAFHEKNYLGLRNLMSIGGHRCRIEAFKKKVWEDLLALTGISTQMMDNYNRRKKGYDRSRQNEDKRIKKDLNEIKRKPKPPYMY

SEQ ID NO: 834 - protein, 306 aa, unidentified
  source 1..306: note = MG152-5
MAFWRTKKWSYMYRKHNSSIPDEMDVCSMFDSSDESDSSDESDSSDEADSSDESDSSDEADSSDECDSSEESDSADKSKTGYKRIKSKHPRRTYNVEDKKENGNIIQHIYNTGLDHDDWSEAMDTFLVCKINGVHNPKIMRNNSENHAEQLLIQNLRKKYKEKKMPFKLTVYINNSPCSMCAKALENFLNKNKNVKLTFYVTNMYHIKRNSCLKARHFEHLNSIPKKSHKANSEGLRDLLRHKRCNIKAFNMGVWKELLNTVDVLSKVKTKLIGGYNRIQYANKRSRGYEDDLIKKDLTYLKSYKK

SEQ ID NO: 835 - protein, 211 aa, unidentified
  source 1..211: note = MG152-6
MPGEIEIEHHDSKIRHMYETVLDHRHGWNKAMTTNLICRINSEDTPLIIQNAHGNKHAEELLLDELNQRDKSLLTTITIYTNNSPCSNKGHDCARQLIKFLNENTHVIMVFYVTNLYKIRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 836 - protein, 972 aa, unidentified; identical to SEQ ID NO: 676
  source 1..972: note = MG68-4_r1v1_nMG34-1

SEQ ID NO: 837 - protein, 972 aa, unidentified
  source 1..972: note = MG68-4_r2v1_nMG34-1
MTDSQNDTDEYWRGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 838 - protein, 972 aa, unidentified
  source 1..972: note = MG68-4_r2v2_nMG34-1
MTDSQNDTDEYWMGEALKLAQKAWDEGEVPVGAILVRKGEVIGHDWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 839 - protein, 972 aa, unidentified
  source 1..972: note = MG68-4_r2v3_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPDLNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 840 - protein, 972 aa, unidentified
  source 1..972: note = MG68-4_r2v4_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGVENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 841 - protein, 972 aa, unidentified
  source 1..972: note = MG68-4_r2v5_nMG34-1
MTDSQNDTDEYWMGEALKLAQKAWDEGEVPVGAILVRKGEVIGHGWNRSIVSHDPSAHAEIMAIREAGVRIGNYHMLDTVLYVTLEPCAMCAGALVHGRISRLVFGAENHKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 842 - protein, 972 aa, unidentified
  source 1..972: note = MG68-4_r2v6_nMG34-1
MTDSQNDTDEYWMGEALKLAQKAWDEGEVPVGAILVREGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 843 - protein, 972 aa, unidentified
  source 1..972: note = MG68-4_r2v7_nMG34-1
MTDSQNGTDGYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 844 - protein, 972 aa, unidentified
  source 1..972: note = MG68-4_r2v8_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFPRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 845 - protein, 972 aa, unidentified
  source 1..972: note = MG68-4_r2v9_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSLGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 846 - protein, 972 aa, unidentified
  source 1..972: note = MG68-4_r2v10_nMG34-1
MADSQNDTDEYWMGEALKLAQKAWDEGEVPVGAILVRKGEVIGHGWNRSIGSHDPSAHAEIMAIREAGVRIGNYRMLDTVLYVTLEPCAMCAGALVYGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 847 - protein, 972 aa, unidentified
  source 1..972: note = MG68-4_r2v11_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNRQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 848 - protein, 972 aa, unidentified
  source 1..972: note = MG68-4_r2v12_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGADNPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 849 - protein, 972 aa, unidentified
  source 1..972: note = MG68-4_r2v13_nMG34-1
MTDSQNDTDEYWMGEALKLAQKAWDEGEVPVAAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 850 - protein, 972 aa, unidentified
  source 1..972: note = MG68-4_r2v14_nMG34-1
MTDSQNDTDEYWMGEALKLAQKAGDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 851 - protein, 972 aa, unidentified
  source 1..972: note = MG68-4_r2v15_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARYPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 852 - protein, 972 aa, unidentified
  source 1..972: note = MG68-4_r2v16_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNNQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 853 - protein, 972 aa, unidentified
  source 1..972: note = MG68-4_r2v17_nMG34-1
MTDSQNDTDEYWMGEALKLAQKAWDEGEVPVGAILVRKGEVIGHGWNRSIGSHDPSAHAEIMAIREAGVRIGNYHMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 854 - protein, 972 aa, unidentified
  source 1..972: note = MG68-4_r2v18_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVLGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 855 - protein, 972 aa, unidentified
  source 1..972: note = MG68-4_r2v19_nMG34-1
MTDSQNDTDEYWMGEALKLAQKAWDEGEVPVGAILVRKGEVIGHGWNRSIGSHDPSAHAEIMSIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 856 - protein, 972 aa, unidentified
  source 1..972: note = MG68-4_r2v20_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMRAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 857 - protein, 972 aa, unidentified
  source 1..972: note = MG68-4_r2v21_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAWALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 858 - protein, 972 aa, unidentified
  source 1..972: note = MG68-4_r2v22_nMG34-1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFSRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 859 - protein, 972 aa, unidentified
  source 1..972: note = MG68-4_r2v23_nMG34-1
MTDSQNDTDEYWMGEALKLAQKAWDEGEVPVGAILVRKGEVIGHGWNRSIGSHDPSAHAEIMAIRVAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 860 - protein, 972 aa, unidentified
  source 1..972: note = MG68-4_r2v24_nMG34-1
MTDSQNDTDEYWMGEALKLAQKAWDEGEVPVGAILVRKGEVIGHGWNRSIGSHDPSAHAEIMAIRDAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 861 - DNA, 20 bp, synthetic construct
  source 1..20: mol_type = other DNA; note = guide 1 for ABE using MG34-1
gaacacaaagcatagactgc

SEQ ID NO: 862 - DNA, 20 bp, synthetic construct
  source 1..20: mol_type = other DNA; note = guide 2 for ABE using MG34-1
gggaaagacccagcatccgt

SEQ ID NO: 863 - DNA, 20 bp, synthetic construct
  source 1..20: mol_type = other DNA; note = guide 3 for ABE using MG34-1
gatgagaaggagaagttctt

SEQ ID NO: 864 - DNA, 21 bp, synthetic construct
  source 1..21: mol_type = other DNA; note = guide 4 for ABE using MG34-1
ggtcgtagccagtccgaaccc

SEQ ID NO: 865 - DNA, 21 bp, synthetic construct
  source 1..21: mol_type = other DNA; note = NGS primer for guide 1 of ABE using MG34-1
ggtcgtagccagtccgaaccc

SEQ ID NO: 866 - DNA, 39 bp, synthetic construct; identical to SEQ ID NO: 691
  source 1..39: mol_type = other DNA; note = NGS primer for guide 1 of ABE using MG34-1

SEQ ID NO: 867 - DNA, 36 bp, synthetic construct; identical to SEQ ID NO: 692
  source 1..36: mol_type = other DNA; note = NGS primer for guide 2 of ABE using MG34-1

SEQ ID NO: 868 - DNA, 36 bp, synthetic construct; identical to SEQ ID NO: 693
  source 1..36: mol_type = other DNA; note = NGS primer for guide 2 of ABE using MG34-1

SEQ ID NO: 869 - DNA, 41 bp, synthetic construct; identical to SEQ ID NO: 702
  source 1..41: mol_type = other DNA; note = NGS primer for guide 3 of ABE using MG34-1

SEQ ID NO: 870 - DNA, 36 bp, synthetic construct; identical to SEQ ID NO: 703
  source 1..36: mol_type = other DNA; note = NGS primer for guide 3 of ABE using MG34-1

SEQ ID NO: 871 - DNA, 36 bp, synthetic construct
  source 1..36: mol_type = other DNA; note = NGS primer for guide 4 of ABE using MG34-1
gctcttccgatctnnnnncacccggctgctggaata

SEQ ID NO: 872 - DNA, 36 bp, synthetic construct
  source 1..36: mol_type = other DNA; note = NGS primer for guide 4 of ABE using MG34-1
gctcttccgatctnnnnntgtgtgtgtgtgtagggc

SEQ ID NO: 873 - DNA, 3348 bp, synthetic construct; identical to SEQ ID NO: 720
  source 1..3348: mol_type = other DNA; note = pCMV-MG68-4_r1v1_nMG34-1

SEQ ID NO: 874 - DNA, 2870 bp, synthetic construct
  source 1..2870: mol_type = other DNA; note = pCMV-U6p-spacer (guide 1)-MG34-1 sgRNA scaffold
ttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgaagcttgagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaacacaaagcatagactgcgttacagttaagaaattaattgtaaaacgcctatacagtgaagggatatacgcttgggtttgtccagcctgagcctctatgccagaaatggcgccttcatcgtgggttaggacatttaatttttttcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgcatgctggggatgcggtgggctctatggc

SEQ ID NO: 875 - DNA, 9519 bp, synthetic construct; identical to SEQ ID NO: 486
  source 1..9519: mol_type = other DNA; note = pAL478

SEQ ID NO: 876 - DNA, 123 bp, synthetic construct; identical to SEQ ID NO: 489
  source 1..123: mol_type = other DNA; note = MG34-1

SEQ ID NO: 877 - protein, 1846 aa, unidentified
  source 1..1846: note = spCAS9+MG139-12+MG69-1
MTFLRMDIPDGPLAGRPVRSRMDGVHPVHGRVLALQRAAGNAATTSALGTVQRSVVDEIARMKPDQLVVALQELNPKAAATNLWVTVDGKPVTELISRPAGFESLWPIQSGRGPHAEERFAQGVMPLLAARQPRYILLEITKSPCPSCTALLSQLVGEHPGTRFELHMLGLYPGAGEAEGERGAATRPEDLAELERKLQAKLLDLRAVIDRLTDEQWRKRFKYPKHTKIPIGTRIAALKFARSVHTTMVEARLKLGERQDQTAYGAKLKDLEDKFAELAAFLTAKKADATASARHEPYPAHETGRPTPAAETVTDLDRWTAIKAECPDLQLSEQTYGEYFLYSSHRAFTWFYVHNSLPESGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 878 - protein, 1723 aa, unidentified
  source 1..1723: note = spCAS9+MG93-4+MG69-1
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWRSGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 879 - protein, 1732 aa, unidentified
  source 1..1732: note = spCAS9+MG93-3+MG69-1
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYWHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAESGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 880 - protein, 1716 aa, unidentified
  source 1..1716: note = spCAS9+MG93-5+MG69-1
MTTMRGPAAGDATLRRRIEPWDFQDFFDPRDLRRETCLLYEINWGGRHSVWRHTGKNTSNHVEVNFIEKFTSERYYSPSARCSIIWFLSWSPCWECSKAIIEFLHQHRNVTLFIYVARLFHHTDLRNRQGIRDLISSGVTIQIMTEPEYCYCWRYFVNYPPGSEVHWPRYPRQWMMLYVLELQCIILGLPSCVKILRRHQNQLTIFTLDLQNCHYQMIPPHILLATGLISGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 881 - protein, 1715 aa, unidentified
  source 1..1715: note = spCAS9+MG93-6+MG69-1
MSSQTGPAVVDPTLRRRIEPQDFEAFFDPRELRKETCLLYEISWGGRHNTWRHTSRNTDKHVEINFIKKLTSERSFRPSARCSITWFLSWSPCWECSKAITEFLSQHPNVTLFIYVARLYHHMDPGNRQGLRNLVCRGVTVQIMTEQEYCYCWKNFVNYPPSNEVYWPRFPNVWMKLYILELLCIILGLPPCLRILRRNQCQATLFTLVFQGCHFQRIPPPIFWATGMSGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 882 - protein, 1715 aa, unidentified
  source 1..1715: note = spCAS9+MG93-7+MG69-1
MSSETGPAVVDPTLRRRIEPQEFEVFFDPRELRKETCLLYEISWGGRRSIWRHTSRNTDKHVEINFIEKLTSERSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRQGTLFTLVFQRCHYQRIPPPIVWARGMSGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 883 - protein, 1723 aa, unidentified
  source 1..1723: note = spCAS9+MG93-9+MG69-1
MTSEKGPSTGDATLRRRIEPWEFEVFFNPGELRKETCMFYEIKWGTSQKIWRNSSKNTTNHVEVNFIEKFTAERHFCPSISCSITWFLSWSPCWECSKAIREFLSQHPNTTLVIYTARLFQHMDQQNRQGLRDLINSGVTVQIMTISEYCYCWRNFVNYSPKEETHWPKYQPLLMMLYALELHCIILSLPPCLKISRRYQKQLTFFNLILQNCHYQTIPPHILLSLGLIQPSVTWRSGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 884 - protein, 1715 aa, unidentified
  source 1..1715: note = spCAS9+MG93-11+MG69-1
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGMSGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 885 - protein, 1666 aa, unidentified
  source 1..1666: note = spCAS9+MG138-17+MG69-1
MRKETGMYISKAALKHNFNPHETPKDTYLLCKLQWGETGTPWIHWVRNERYHHAESYFLEKIFKMRRSSNYVKCNITWYLSWSPCADCCHKILNFLKRHSNVNIDIYVARLYYIEDEEIRQCLKNLVSLAEVTIAVMKIEDYIYCQKKFIQGGDDDDSWTVSFQPEISKNRLKLKDVFESGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 886 - protein, 1670 aa, unidentified
  source 1..1670: note = spCAS9+MG138-20+MG69-1
MYKKKLRGMYMSKKAFKYHFDPRESPRATYLLCVIQWGCNGLPWIHWVKNGRSHAERYFLQKVFKMRRSNNNINCSITLYLSWSPCRNCCYEMQYFLKKHPNVNICIYLARLYYTEDEEICKALKDLSEKKVIISVMKIEDYIYCWKTFVSGNAAAGSWFKDFESQINKNHFQLKRILEVSPLSGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 887 - protein, 1680 aa, unidentified
  source 1..1680: note = spCAS9+MG138-23+MG69-1
MAAVSARGPSSRENNQGWKMQPEDFQRNYSPRQNGRVYLLYEIRWRSSSIWRNWCSNNPEQHAEVNFLENHFNNQPQTPCCITWFLSASPCGNCCRRILKFLRSHPNVTLVICAAKLFRHLDIRNRRGLRSLMMNGVAIRIMNLEDYRYCWRNFVAHQPGQDDYWPQNVTLYFILNSIELLHIFLDLPPFLANSGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 888 - protein, 1861 aa, unidentified
  source 1..1861: note = spCAS9+MG138-32+MG69-1
MYRRKMRGMYISKRALRIHFDPCKFPKETYLLCELQWRGSTKFWQHWVRNDHDYEDCHAEQYFLDEVFEPRSYNICDMTWYLSWSPCRECCDIIRDFLEEQPNVNIDIRVARLYYTNIPRYRDGLRELHSLEGVTIKAMEAEDYNYCWETFIQPGVNYYFSPNNFKSEIQRNRTKLEDILQGLHLYARITVLLVLFFRWKMQPRDFQRNYSPRQNGRVYLLYEIRWRRGSIWRNWCSNNHEQHAEVNFLENHFSVRPQTPCSITWFLSTSPCGKCSRRILEFLRSHPNVTLVIYAAKLFRHHDNRNRQGLRNLIMNGVTLRIMNLEDYRYCWRNFVAYQTGEDDYWPQNVTLYFLLNSTELLHIFWGLPPFLANSGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 889 - protein, 1692 aa, unidentified
  source 1..1692: note = spCAS9+MG142-1+MG69-1
MERSSGRDWLDECCPRGCKYTSNYRGPMKGLFQKAFYFHFENLHYADHRRKTFLCFEVTRLQDNKFRKGMFINQVGPYRLHAELRFLSWFHDSWLCPYASYEVTWYMSWSPCEECMEELAAFLANHRNVTLTIYVARLYYYQEPTCGEGLQALLNEGASVNIMFFRDFLDCWRRFVYNGNEYFEPWPHLHQNSLKYFHILEELLESGTETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 890 - protein, 1613 aa, unidentified
  source 1..1613: note = MG3-6+MG139-12+MG69-1
MTFLRMDIPDGPLAGRPVRSRMDGVHPVHGRVLALQRAAGNAATTSALGTVQRSVVDEIARMKPDQLVVALQELNPKAAATNLWVTVDGKPVTELISRPAGFESLWPIQSGRGPHAEERFAQGVMPLLAARQPRYILLEITKSPCPSCTALLSQLVGEHPGTRFELHMLGLYPGAGEAEGERGAATRPEDLAELERKLQAKLLDLRAVIDRLTDEQWRKRFKYPKHTKIPIGTRIAALKFARSVHTTMVEARLKLGERQDQTAYGAKLKDLEDKFAELAAFLTAKKADATASARHEPYPAHETGRPTPAAETVTDLDRWTAIKAECPDLQLSEQTYGEYFLYSSHRAFTWFYVHNSLPESGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 891 - protein, 1490 aa, unidentified
  source 1..1490: note = MG3-6+MG93-4+MG69-1
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWRSGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 892 - protein, 1499 aa, unidentified
  source 1..1499: note = MG3-6+MG93-3+MG69-1
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYWHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAESGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 893 - protein, 1483 aa, unidentified
  source 1..1483: note = MG3-6+MG93-5+MG69-1
MTTMRGPAAGDATLRRRIEPWDFQDFFDPRDLRRETCLLYEINWGGRHSVWRHTGKNTSNHVEVNFIEKFTSERYYSPSARCSIIWFLSWSPCWECSKAIIEFLHQHRNVTLFIYVARLFHHTDLRNRQGIRDLISSGVTIQIMTEPEYCYCWRYFVNYPPGSEVHWPRYPRQWMMLYVLELQCIILGLPSCVKILRRHQNQLTIFTLDLQNCHYQMIPPHILLATGLISGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 894 - protein, 1482 aa, unidentified
  source 1..1482: note = MG3-6+MG93-6+MG69-1
MSSQTGPAVVDPTLRRRIEPQDFEAFFDPRELRKETCLLYEISWGGRHNTWRHTSRNTDKHVEINFIKKLTSERSFRPSARCSITWFLSWSPCWECSKAITEFLSQHPNVTLFIYVARLYHHMDPGNRQGLRNLVCRGVTVQIMTEQEYCYCWKNFVNYPPSNEVYWPRFPNVWMKLYILELLCIILGLPPCLRILRRNQCQATLFTLVFQGCHFQRIPPPIFWATGMSGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 895 - protein, 1482 aa, unidentified
  source 1..1482: note = MG3-6+MG93-7+MG69-1
MSSETGPAVVDPTLRRRIEPQEFEVFFDPRELRKETCLLYEISWGGRRSIWRHTSRNTDKHVEINFIEKLTSERSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRQGTLFTLVFQRCHYQRIPPPIVWARGMSGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 896 - protein, 1490 aa, unidentified
  source 1..1490: note = MG3-6+MG93-9+MG69-1
MTSEKGPSTGDATLRRRIEPWEFEVFFNPGELRKETCMFYEIKWGTSQKIWRNSSKNTTNHVEVNFIEKFTAERHFCPSISCSITWFLSWSPCWECSKAIREFLSQHPNTTLVIYTARLFQHMDQQNRQGLRDLINSGVTVQIMTISEYCYCWRNFVNYSPKEETHWPKYQPLLMMLYALELHCIILSLPPCLKISRRYQKQLTFFNLILQNCHYQTIPPHILLSLGLIQPSVTWRSGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 897 - protein, 1482 aa, unidentified
  source 1..1482: note = MG3-6+MG93-11+MG69-1
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGMSGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 898 - protein, 1433 aa, unidentified
  source 1..1433: note = MG3-6+MG138-17+MG69-1
MRKETGMYISKAALKHNFNPHETPKDTYLLCKLQWGETGTPWIHWVRNERYHHAESYFLEKIFKMRRSSNYVKCNITWYLSWSPCADCCHKILNFLKRHSNVNIDIYVARLYYIEDEEIRQCLKNLVSLAEVTIAVMKIEDYIYCQKKFIQGGDDDDSWTVSFQPEISKNRLKLKDVFESGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 899 - protein, 1437 aa, unidentified
  source 1..1437: note = MG3-6+MG138-20+MG69-1
MYKKKLRGMYMSKKAFKYHFDPRESPRATYLLCVIQWGCNGLPWIHWVKNGRSHAERYFLQKVFKMRRSNNNINCSITLYLSWSPCRNCCYEMQYFLKKHPNVNICIYLARLYYTEDEEICKALKDLSEKKVIISVMKIEDYIYCWKTFVSGNAAAGSWFKDFESQINKNHFQLKRILEVSPLSGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 900 - protein, 1447 aa, unidentified
  source 1..1447: note = MG3-6+MG138-23+MG69-1
MAAVSARGPSSRENNQGWKMQPEDFQRNYSPRQNGRVYLLYEIRWRSSSIWRNWCSNNPEQHAEVNFLENHFNNQPQTPCCITWFLSASPCGNCCRRILKFLRSHPNVTLVICAAKLFRHLDIRNRRGLRSLMMNGVAIRIMNLEDYRYCWRNFVAHQPGQDDYWPQNVTLYFILNSIELLHIFLDLPPFLANSGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 901 - protein, 1628 aa, unidentified
  source 1..1628: note = MG3-6+MG138-32+MG69-1
MYRRKMRGMYISKRALRIHFDPCKFPKETYLLCELQWRGSTKFWQHWVRNDHDYEDCHAEQYFLDEVFEPRSYNICDMTWYLSWSPCRECCDIIRDFLEEQPNVNIDIRVARLYYTNIPRYRDGLRELHSLEGVTIKAMEAEDYNYCWETFIQPGVNYYFSPNNFKSEIQRNRTKLEDILQGLHLYARITVLLVLFFRWKMQPRDFQRNYSPRQNGRVYLLYEIRWRRGSIWRNWCSNNHEQHAEVNFLENHFSVRPQTPCSITWFLSTSPCGKCSRRILEFLRSHPNVTLVIYAAKLFRHHDNRNRQGLRNLIMNGVTLRIMNLEDYRYCWRNFVAYQTGEDDYWPQNVTLYFLLNSTELLHIFWGLPPFLANSGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 902 - protein, 1459 aa, unidentified
  source 1..1459: note = MG3-6+MG142-1+MG69-1
MERSSGRDWLDECCPRGCKYTSNYRGPMKGLFQKAFYFHFENLHYADHRRKTFLCFEVTRLQDNKFRKGMFINQVGPYRLHAELRFLSWFHDSWLCPYASYEVTWYMSWSPCEECMEELAAFLANHRNVTLTIYVARLYYYQEPTCGEGLQALLNEGASVNIMFFRDFLDCWRRFVYNGNEYFEPWPHLHQNSLKYFHILEELLESGTETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 903 - protein, 1248 aa, unidentified
  source 1..1248: note = MG34-1+MG139-12+MG69-1
MTFLRMDIPDGPLAGRPVRSRMDGVHPVHGRVLALQRAAGNAATTSALGTVQRSVVDEIARMKPDQLVVALQELNPKAAATNLWVTVDGKPVTELISRPAGFESLWPIQSGRGPHAEERFAQGVMPLLAARQPRYILLEITKSPCPSCTALLSQLVGEHPGTRFELHMLGLYPGAGEAEGERGAATRPEDLAELERKLQAKLLDLRAVIDRLTDEQWRKRFKYPKHTKIPIGTRIAALKFARSVHTTMVEARLKLGERQDQTAYGAKLKDLEDKFAELAAFLTAKKADATASARHEPYPAHETGRPTPAAETVTDLDRWTAIKAECPDLQLSEQTYGEYFLYSSHRAFTWFYVHNSLPESGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 904 - protein, 1125 aa, unidentified
  source 1..1125: note = MG34-1+MG93-4+MG69-1
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWRSGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 905 - protein, 1134 aa, unidentified
  source 1..1134: note = MG34-1+MG93-3+MG69-1
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYWHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAESGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 906 - protein, 1118 aa, unidentified
  source 1..1118: note = MG34-1+MG93-5+MG69-1
MTTMRGPAAGDATLRRRIEPWDFQDFFDPRDLRRETCLLYEINWGGRHSVWRHTGKNTSNHVEVNFIEKFTSERYYSPSARCSIIWFLSWSPCWECSKAIIEFLHQHRNVTLFIYVARLFHHTDLRNRQGIRDLISSGVTIQIMTEPEYCYCWRYFVNYPPGSEVHWPRYPRQWMMLYVLELQCIILGLPSCVKILRRHQNQLTIFTLDLQNCHYQMIPPHILLATGLISGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 907 - protein, 1117 aa, unidentified
  source 1..1117: note = MG34-1+MG93-6+MG69-1
MSSQTGPAVVDPTLRRRIEPQDFEAFFDPRELRKETCLLYEISWGGRHNTWRHTSRNTDKHVEINFIKKLTSERSFRPSARCSITWFLSWSPCWECSKAITEFLSQHPNVTLFIYVARLYHHMDPGNRQGLRNLVCRGVTVQIMTEQEYCYCWKNFVNYPPSNEVYWPRFPNVWMKLYILELLCIILGLPPCLRILRRNQCQATLFTLVFQGCHFQRIPPPIFWATGMSGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 908 - protein, 1117 aa, synthetic construct
  source 1..1117: note = MG34-1+MG93-7+MG69-1
MSSETGPAVVDPTLRRRIEPQEFEVFFDPRELRKETCLLYEISWGGRRSIWRHTSRNTDKHVEINFIEKLTSERSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRQGTLFTLVFQRCHYQRIPPPIVWARGMSGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 909 - protein, 1125 aa, unidentified
  source 1..1125: note = MG34-1+MG93-9+MG69-1
MTSEKGPSTGDATLRRRIEPWEFEVFFNPGELRKETCMFYEIKWGTSQKIWRNSSKNTTNHVEVNFIEKFTAERHFCPSISCSITWFLSWSPCWECSKAIREFLSQHPNTTLVIYTARLFQHMDQQNRQGLRDLINSGVTVQIMTISEYCYCWRNFVNYSPKEETHWPKYQPLLMMLYALELHCIILSLPPCLKISRRYQKQLTFFNLILQNCHYQTIPPHILLSLGLIQPSVTWRSGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 910 - protein, 1117 aa, unidentified
  source 1..1117: note = MG34-1+MG93-11+MG69-1
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGMSGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 911 - protein, 1068 aa, unidentified
  source 1..1068: note = MG34-1+MG138-17+MG69-1
MRKETGMYISKAALKHNFNPHETPKDTYLLCKLQWGETGTPWIHWVRNERYHHAESYFLEKIFKMRRSSNYVKCNITWYLSWSPCADCCHKILNFLKRHSNVNIDIYVARLYYIEDEEIRQCLKNLVSLAEVTIAVMKIEDYIYCQKKFIQGGDDDDSWTVSFQPEISKNRLKLKDVFESGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 912 - protein, 1072 aa, synthetic construct
  source 1..1072: note = MG34-1+MG138-20+MG69-1
MYKKKLRGMYMSKKAFKYHFDPRESPRATYLLCVIQWGCNGLPWIHWVKNGRSHAERYFLQKVFKMRRSNNNINCSITLYLSWSPCRNCCYEMQYFLKKHPNVNICIYLARLYYTEDEEICKALKDLSEKKVIISVMKIEDYIYCWKTFVSGNAAAGSWFKDFESQINKNHFQLKRILEVSPLSGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 913 - protein, 1082 aa, unidentified
  source 1..1082: note = MG34-1+MG138-23+MG69-1
MAAVSARGPSSRENNQGWKMQPEDFQRNYSPRQNGRVYLLYEIRWRSSSIWRNWCSNNPEQHAEVNFLENHFNNQPQTPCCITWFLSASPCGNCCRRILKFLRSHPNVTLVICAAKLFRHLDIRNRRGLRSLMMNGVAIRIMNLEDYRYCWRNFVAHQPGQDDYWPQNVTLYFILNSIELLHIFLDLPPFLANSGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 914 - protein, 1263 aa, unidentified
  source 1..1263: note = MG34-1+MG138-32+MG69-1
MYRRKMRGMYISKRALRIHFDPCKFPKETYLLCELQWRGSTKFWQHWVRNDHDYEDCHAEQYFLDEVFEPRSYNICDMTWYLSWSPCRECCDIIRDFLEEQPNVNIDIRVARLYYTNIPRYRDGLRELHSLEGVTIKAMEAEDYNYCWETFIQPGVNYYFSPNNFKSEIQRNRTKLEDILQGLHLYARITVLLVLFFRWKMQPRDFQRNYSPRQNGRVYLLYEIRWRRGSIWRNWCSNNHEQHAEVNFLENHFSVRPQTPCSITWFLSTSPCGKCSRRILEFLRSHPNVTLVIYAAKLFRHHDNRNRQGLRNLIMNGVTLRIMNLEDYRYCWRNFVAYQTGEDDYWPQNVTLYFLLNSTELLHIFWGLPPFLANSGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 915 - protein, 1094 aa, unidentified
  source 1..1094: note = MG34-1+MG142-1+MG69-1
MERSSGRDWLDECCPRGCKYTSNYRGPMKGLFQKAFYFHFENLHYADHRRKTFLCFEVTRLQDNKFRKGMFINQVGPYRLHAELRFLSWFHDSWLCPYASYEVTWYMSWSPCEECMEELAAFLANHRNVTLTIYVARLYYYQEPTCGEGLQALLNEGASVNIMFFRDFLDCWRRFVYNGNEYFEPWPHLHQNSLKYFHILEELLESGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 916 - protein, 1096 aa, unidentified
  source 1..1096: note = MG34-1+A0A2K5RDN7(APOBEC 3A)+MG69-1
MEASPASRPRPLMGPRTFTENFTNNPEVFGRHQTYLCYEVKCQGPDGTRDLMTEQRDFLCNQARNLLSGFDGRHAERCFLDRVPSWRLDPAQTYRVTCFISWSPCFSCAREVAEFLQENPHVNLRIFAARIYDCRPRYEEGLQMLQNAGAQVSIMTSEEFRHCWDTFVDHQGHPFQPWEGLDEHSQALSRRLQAILQGNRWMILSLGSGTETPGTSESATPESMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELESGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVPHPHSPTPDRTSVISHVSGV

SEQ ID NO: 917 - DNA, 96 bp, synthetic construct
  source 1..96: mol_type = other DNA; note = sgRNA266
ggcccagactgagcacgtgagttttagagctagaaatagcaagttaaaataaggctagtccgttatcaacttgaaaaagtggcaccgagtcggtgc

SEQ ID NO: 918 - DNA, 96 bp, synthetic construct
  source 1..96: mol_type = other DNA; note = sgRNA691
ttgccacgaagcaggccaatgttttagagctagaaatagcaagttaaaataaggctagtccgttatcaacttgaaaaagtggcaccgagtcggtgc

SEQ ID NO: 919 - DNA, 97 bp, synthetic construct
  source 1..97: mol_type = other DNA; note = sgRNA692
ccccggggccgccattgacaggttttagagctagaaatagcaagttaaaataaggctagtccgttatcaacttgaaaaagtggcaccgagtcggtgc

SEQ ID NO: 920 - DNA, 96 bp, synthetic construct
  source 1..96: mol_type = other DNA; note = sgRNA693
tccggctctgagggccagtggttttagagctagaaatagcaagttaaaataaggctagtccgttatcaacttgaaaaagtggcaccgagtcggtgc

SEQ ID NO: 921 - DNA, 96 bp, synthetic construct
  source 1..96: mol_type = other DNA; note = sgRNA694
caaccagtccccagtgactcgttttagagctagaaatagcaagttaaaataaggctagtccgttatcaacttgaaaaagtggcaccgagtcggtgc

SEQ ID NO: 922 - DNA, 106 bp, synthetic construct
  source 1..106: mol_type = other DNA; note = sgRNA708
gattccggctctgagggccagtgttgagaatcgaaagattcttaataaggcatccttccgatgctgacttctcaccgtccgttttccaataggagcgggcggtatg

SEQ ID NO: 923 - DNA, 106 bp, synthetic construct
  source 1..106: mol_type = other DNA; note = sgRNA709
gcccttctgtttgtcccacttggttgagaatcgaaagattcttaataaggcatccttccgatgctgacttctcaccgtccgttttccaataggagcgggcggtatg

SEQ ID NO: 924 - DNA, 106 bp, synthetic construct
  source 1..106: mol_type = other DNA; note = sgRNA710
ttggccaagccaggcctagaatgttgagaatcgaaagattcttaataaggcatccttccgatgctgacttctcaccgtccgttttccaataggagcgggcggtatg

SEQ ID NO: 925 - DNA, 106 bp, synthetic construct
  source 1..106: mol_type = other DNA; note = sgRNA711
ctcagctggtacacggcagggtgttgagaatcgaaagattcttaataaggcatccttccgatgctgacttctcaccgtccgttttccaataggagcgggcggtatg

SEQ ID NO: 926 - DNA, 106 bp, synthetic construct
  source 1..106: mol_type = other DNA; note = sgRNA712
tcgcctatgggaactctggagggttgagaatcgaaagattcttaataaggcatccttccgatgctgacttctcaccgtccgttttccaataggagcgggcggtatg

SEQ ID NO: 927 - DNA, 139 bp, synthetic construct
  source 1..139: mol_type = other DNA; note = sgRNA633
gaacacaaagcatagactgcgttacagttaagaaattaattgtaaaacgcctatacagtgaagggatatacgcttgggtttgtccagcctgagcctctatgccagaaatggcgccttcatcgtgggttaggacatttaa

SEQ ID NO: 928 - DNA, 139 bp, synthetic construct
  source 1..139: mol_type = other DNA; note = sgRNA634
gggaaagacccagcatccgtgttacagttaagaaattaattgtaaaacgcctatacagtgaagggatatacgcttgggtttgtccagcctgagcctctatgccagaaatggcgccttcatcgtgggttaggacatttaa

SEQ ID NO: 929 - DNA, 139 bp, synthetic construct
  source 1..139: mol_type = other DNA; note = sgRNA635
gatgagaaggagaagttcttgttacagttaagaaattaattgtaaaacgcctatacagtgaagggatatacgcttgggtttgtccagcctgagcctctatgccagaaatggcgccttcatcgtgggttaggacatttaa

SEQ ID NO: 930 - DNA, 139 bp, synthetic construct
  source 1..139: mol_type = other DNA; note = sgRNA636
agcaaacgcgttcagggcctgttacagttaagaaattaattgtaaaacgcctatacagtgaagggatatacgcttgggtttgtccagcctgagcctctatgccagaaatggcgccttcatcgtgggttaggacatttaa

SEQ ID NO: 931 - DNA, 140 bp, synthetic construct
  source 1..140: mol_type = other DNA; note = sgRNA641
ggtcgtagccagtccgaacccgttacagttaagaaattaattgtaaaacgcctatacagtgaagggatatacgcttgggtttgtccagcctgagcctctatgccagaaatggcgccttcatcgtgggttaggacatttaa

SEQ ID NO: 932 - DNA, 20 bp, synthetic construct
  source 1..20: mol_type = other DNA; note = NGS primer for sgRNA266
gcatgcatttgtaggcttga

SEQ ID NO: 933 - DNA, 19 bp, synthetic construct
  source 1..19: mol_type = other DNA; note = NGS primer for sgRNA266
ccctgtctaggaaaagctg

SEQ ID NO: 934 - DNA, 18 bp, synthetic construct
  source 1..18: mol_type = other DNA; note = NGS primer for sgRNA691
ggaggaggaagggcctga

SEQ ID NO: 935 - DNA, 18 bp, synthetic construct
  source 1..18: mol_type = other DNA; note = NGS primer for sgRNA691
actctgccctcgtgggtt

SEQ ID NO: 936 - DNA, 18 bp, synthetic construct
  source 1..18: mol_type = other DNA; note = NGS primer for sgRNA692
gactctggccactccctg

SEQ ID NO: 937 - DNA, 18 bp, synthetic construct
  source 1..18: mol_type = other DNA; note = NGS primer for sgRNA692
caggcaggctctccgagg

SEQ ID NO: 938 - DNA, 26 bp, synthetic construct
  source 1..26: mol_type = other DNA; note = NGS primer for sgRNA693
aataaaagtctctctcttaatgacac

SEQ ID NO: 939 - DNA, 18 bp, synthetic construct
  source 1..18: mol_type = other DNA; note = NGS primer for sgRNA693
gaccccctccaccagtac

SEQ ID NO: 940 - DNA, 18 bp, synthetic construct
  source 1..18: mol_type = other DNA; note = NGS primer for sgRNA694
cacctgtccttggagaac

SEQ ID NO: 941 - DNA, 18 bp, synthetic construct
  source 1..18: mol_type = other DNA; note = NGS primer for sgRNA694
ggcaggtgaacacaagag

SEQ ID NO: 942 - DNA, 27 bp, synthetic construct
  source 1..27: mol_type = other DNA; note = NGS primer for sgRNA708
aataataaaagtctctctcttaatgac

SEQ ID NO: 943 - DNA, 18 bp, synthetic construct
  source 1..18: mol_type = other DNA; note = NGS primer for sgRNA708
accccctccaccagtacc

SEQ ID NO: 944 - DNA, 18 bp, synthetic construct
  source 1..18: mol_type = other DNA; note = NGS primer for sgRNA709
ctcagggcctcctcagcc

SEQ ID NO: 945 - DNA, 18 bp, synthetic construct
  source 1..18: mol_type = other DNA; note = NGS primer for sgRNA709
gtctggatgtcgtaaggg

SEQ ID NO: 946 - DNA, 22 bp, synthetic construct
  source 1..22: mol_type = other DNA; note = NGS primer for sgRNA710
ggggtgtaactcagaatgtttt

SEQ ID NO: 947 - DNA, 18 bp, synthetic construct
  source 1..18: mol_type = other DNA; note = NGS primer for sgRNA710
gggagtgagactcagaga

SEQ ID NO: 948 - DNA, 21 bp, synthetic construct
  source 1..21: mol_type = other DNA; note = NGS primer for sgRNA711
gcaaagagggaaatgagatca

SEQ ID NO: 949 - DNA, 23 bp, synthetic construct
  source 1..23: mol_type = other DNA; note = NGS primer for sgRNA711
gtgacacatttgtttgagaatca

SEQ ID NO: 950 - DNA, 18 bp, synthetic construct
  source 1..18: mol_type = other DNA; note = NGS primer for sgRNA712
ctttatccccgcacagag

SEQ ID NO: 951 - DNA, 18 bp, synthetic construct
  source 1..18: mol_type = other DNA; note = NGS primer for sgRNA712
cttggcccatgggaaatc

SEQ ID NO: 952 - DNA, 18 bp, synthetic construct
  source 1..18: mol_type = other DNA; note = NGS primer for sgRNA633
ctggctgagctaactgtg

SEQ ID NO: 953 - DNA, 21 bp, synthetic construct
  source 1..21: mol_type = other DNA; note = NGS primer for sgRNA633
aactgtgcgtatgacatcatc

SEQ ID NO: 954 - DNA, 18 bp, synthetic construct
  source 1..18: mol_type = other DNA; note = NGS primer for sgRNA634
catgcgccggcacgcccc

SEQ ID NO: 955 - DNA, 18 bp, synthetic construct
  source 1..18: mol_type = other DNA; note = NGS primer for sgRNA634
gggtctctagaccagcgt

SEQ ID NO: 956 - DNA, 23 bp, synthetic construct
  source 1..23: mol_type = other DNA; note = NGS primer for sgRNA635
aagacatgaaaatgtgcttgatg

SEQ ID NO: 957 - DNA, 18 bp, synthetic construct
  source 1..18: mol_type = other DNA; note = NGS primer for sgRNA635
ctgaggagggcccccctg

SEQ ID NO: 958 - DNA, 18 bp, synthetic construct
  source 1..18: mol_type = other DNA; note = NGS primer for sgRNA636
tccagctccagccccaga

SEQ ID NO: 959 - DNA, 26 bp, synthetic construct
  source 1..26: mol_type = other DNA; note = NGS primer for sgRNA636
aacaaaagagaggagttaatgaatta

SEQ ID NO: 960 - DNA, 18 bp, synthetic construct
  source 1..18: mol_type = other DNA; note = NGS primer for sgRNA641
cacccggctgctggaata

SEQ ID NO: 961 - RNA, 18 nt, synthetic construct
  source 1..18: mol_type = other RNA; note = NGS primer for sgRNA641
tgtgtgtgtgtgtagggc

SEQ ID NO: 962 - DNA, 476 bp, synthetic construct; identical to SEQ ID NO: 708
  source 1..476: mol_type = other DNA; note = Site enginereed in mammalian cell line with 5 PAMs compatible with Cas9 and MG3-6 editing

SEQ ID NO: 963 - DNA, 22 bp, synthetic construct
  source 1..22: mol_type = other DNA; note = Spacer targeting engineered site #1
ggggatccaccggagcttaaga

SEQ ID NO: 964 - DNA, 22 bp, synthetic construct
  source 1..22: mol_type = other DNA; note = Spacer targeting engineered site #2
tccaccggagcttaagacggga

SEQ ID NO: 965 - DNA, 22 bp, synthetic construct
  source 1..22: mol_type = other DNA; note = Spacer targeting engineered site #3
cggagcttaagacgggactagg

SEQ ID NO: 966 - DNA, 22 bp, synthetic construct
  source 1..22: mol_type = other DNA; note = Spacer targeting engineered site #4
cttaagacgggactaggtcagg

SEQ ID NO: 967 - DNA, 22 bp, synthetic construct
  source 1..22: mol_type = other DNA; note = Spacer targeting engineered site #5
gacgggactaggtcaggccggg

SEQ ID NO: 968 - protein, 1694 aa, unidentified
  source 1..1694: note = spCas9+A0A2K5RDN7(APOBEC 3A)+MG69-1
MEASPASRPRPLMGPRTFTENFTNNPEVFGRHQTYLCYEVKCQGPDGTRDLMTEQRDFLCNQARNLLSGFDGRHAERCFLDRVPSWRLDPAQTYRVTCFISWSPCFSCAREVAEFLQENPHVNLRIFAARIYDCRPRYEEGLQMLQNAGAQVSIMTSEEFRHCWDTFVDHQGHPFQPWEGLDEHSQALSRRLQAILQGNRWMILSLGSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 969 - protein, 1461 aa, unidentified
  source 1..1461: note = MG3-6+A0A2K5RDN7(APOBEC 3A)+MG69-1
MEASPASRPRPLMGPRTFTENFTNNPEVFGRHQTYLCYEVKCQGPDGTRDLMTEQRDFLCNQARNLLSGFDGRHAERCFLDRVPSWRLDPAQTYRVTCFISWSPCFSCAREVAEFLQENPHVNLRIFAARIYDCRPRYEEGLQMLQNAGAQVSIMTSEEFRHCWDTFVDHQGHPFQPWEGLDEHSQALSRRLQAILQGNRWMILSLGSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 970 - protein, 359 aa, unidentified; identical to SEQ ID NO: 650
  source 1..359: note = MG139-12

SEQ ID NO: 971 - protein, 245 aa, unidentified; identical to SEQ ID NO: 667
  source 1..245: note = MG93-3

SEQ ID NO: 972 - protein, 236 aa, unidentified; identical to SEQ ID NO: 668
  source 1..236: note = MG93-4

SEQ ID NO: 973 - protein, 229 aa, unidentified; identical to SEQ ID NO: 669
  source 1..229: note = MG93-5

SEQ ID NO: 974 - protein, 228 aa, unidentified; identical to SEQ ID NO: 670
  source 1..228: note = MG93-6

SEQ ID NO: 975 - protein, 228 aa, unidentified; identical to SEQ ID NO: 671
  source 1..228: note = MG93-7

SEQ ID NO: 976 - protein, 236 aa, unidentified; identical to SEQ ID NO: 673
  source 1..236: note = MG93-9

SEQ ID NO: 977 - protein, 228 aa, unidentified; identical to SEQ ID NO: 675
  source 1..228: note = MG93-11

SEQ ID NO: 978 - protein, 179 aa, unidentified; identical to SEQ ID NO: 615
  source 1..179: note = MG138-17

SEQ ID NO: 979 - protein, 183 aa, unidentified; identical to SEQ ID NO: 618
  source 1..183: note = MG138-20

SEQ ID NO: 980 - protein, 193 aa, unidentified; identical to SEQ ID NO: 606
  source 1..193: note = MG138-23

SEQ ID NO: 981 - protein, 374 aa, unidentified; identical to SEQ ID NO: 630
  source 1..374: note = MG138-32

SEQ ID NO: 982 - protein, 205 aa, unidentified; identical to SEQ ID NO: 663
  source 1..205: note = MG142-1

SEQ ID NO: 983 - protein, 149 aa, unidentified
  source 1..149: note = MG128-1 Deaminase
MEEALRQAERAAEGGEVPIGAVVLKDGKILARAHNQVELLKDATAHAEMIALTSAASALDNWRLEGCDVVVTLEPCAMCAGAMVNSRVARIVYGATDPVAGACGSVFDVVSDTRLNHRIPVVRGVLADRCGALLKDFFRSRRTQQSPKS

SEQ ID NO: 984 - protein, 161 aa, unidentified
  source 1..161: note = MG128-2 Deaminase
MTDEQLMRAAIREAAKAGALGETPIGCVIAKEGKIIARGYNRRMTDRQTLAHAELFALRKACKKEGDWRLEDCTLYVTLEPCPMCAGAIVQARIPRVVYGASNPKAGCAGSVLNLLDEPRFNHQVCVEAGVLGDTCAALMRDFFRELRAKRKAEQSEKQEL

SEQ ID NO: 985 - protein, 148 aa, unidentified
  source 1..148: note = MG128-3 Deaminase
MDYEKYMDLALEQAQIAYNSNEVPIGCIIVYNNEVIGKGCNLRVTKGNVLAHAEIIAINEACNFMGDWRLENCTLFVTVEPCPMCAGAILQARVKEVVFGTRNPKAGCVGSVYNLLQDSRFNHQVEITEGVRQEECASIMKDFFKRFR

SEQ ID NO: 986 - protein, 206 aa, unidentified
  source 1..206: note = MG128-4 Deaminase
MDVPLYDPRGPPATLVYDPCVDGLDTDEDFMRLALAEARRAAAEDEVPIGAVLVRGGRVLARDRNRRERLHDPTAHAEMLVITASAAEIESWRLEDSTLYVTLEPCAMCAGAIVLARIPRVVFGAFDPKAGAAGSVLDVLRHARLNHRAEVVGGVLAPECGGLIAEFFAAKRVAAKRAGAGRTRSSPAGGDPPGGEPTGGEPTATT

SEQ ID NO: 987 - protein, 161 aa, unidentified
  source 1..161: note = MG128-5 Deaminase
MESTEEQDIKYMREAVNEASKAIESGEVPIGCVIVYKDEIIGRGHNLRNSKKNPLCHAEISAINEAAGFMGDWRLEECTLYVTVEPCPMCAGAIVQARIPRVVFGTPNVKAGCAGSILNILNEPKFNHQVDVTCGVLREECAAPMSEFFKRFRKKNKETCC

SEQ ID NO: 988 - protein, 216 aa, unidentified
  source 1..216: note = MG128-6 Deaminase
MILLVNIKIMENFKNCDTRADFGDSEYSGLLSAPRKSFPECPFEPMRPSYLNRGDEFFMKLAYNQALKAWSCGEVPIGAVIELGGEVVAQAHNSVESSRDPTAHAEIIAITQAAAKCEDWRLSGATLYVTKEPCPMCAGACVMSRLKRVVYAVSDPKMGFLGGAMKFHDLPTLNHSLIVNSGVLEEDCARLLKTFFSLKRAISKSAKASSSQSGAE

SEQ ID NO: 989 - protein, 159 aa, unidentified
  source 1..159: note = MG128-7 Deaminase
MNDTIYMKEAIEEARRALECGEIPVGAVVVRGEEIIGRGHNVRSRDKSPFGHAEIAAMTEAAKKINSWRFDGCSIYVTLEPCVMCSGALVQCRMGRIVFGARDPKAGGCRSLYEIPRDPRMYHRCGLTGGVLSEECAEMLRIFFRERRKAGIIKKTAPL

SEQ ID NO: 990 - protein, 175 aa, unidentified
  source 1..175: note = MG128-8 Deaminase
MNDSGLIIDRQSDAYYMGQALREARKAYAAGEVPIGAVIVKAGAIISRGWNQVEMLKDGTAHAEMLALTAAEESVGDRRLEGCTLYVTKEPCVMCAGAIILCRPDRVVFGCPDPKVGAVGGWINVLESSPPFNHRCEVTSGVLGEECLFLLQTFFREARDRKKIERIPSISDEEA

SEQ ID NO: 991 - protein, 174 aa, unidentified
  source 1..174: note = MG128-9 Deaminase
MSPEELRFHQHFMRLALREAEKSVAADEVPCGCVIVELPEGCYDPAIAHPPPPDHPWSARILSRGYNQVEMLNDPTAHAEMIAITSATSTLGDRRLNRTALYVTKEPCPMCAGAIVWARPAVVVWGLSDPDRGGESLFKILSSPKTNHRPKIFTGILEAECKTQFTDFFKARRK

SEQ ID NO: 992 - protein, 178 aa, unidentified
  source 1..178: note = MG128-10 Deaminase
MPSAVSFLRVEEPIIDLQSDHYFMGEALRQAARAYEAEEVPVGALVVRDGRVIARASNQVELLKDATAHAEMLAITQAEEAVGDWRLNDCTLYVTKEPCPMCAGAIVHVRFARVVFGASDPRGGAAGSAMNLLQFPTLNHRCEITSGVREEECRQLLLTFFAEQRAKNEKERKQAETN

SEQ ID NO: 993 - protein, 177 aa, unidentified
  source 1..177: note = MG128-11 Deaminase
MPDEPIIDLESDHYFMGEALRQAHRAYQAEEVPIGAVVVQNGQIIGRAYNQVELLKDATAHAEMLALTQAEEVLGDWRLNECTLYVTKEPCPMCAGAIVHTRVARVVFGAPDPKAGAAGGVMNLLQYPTFNHRCEITAGVREQECRALLQSFFVEQRAQKKPIPQQLEGNGEGEELS

SEQ ID NO: 994 - protein, 163 aa, unidentified
  source 1..163: note = MG128-12 Deaminase
MLLAMREAEKAREVGEVPCGCVVVKEGRVIARGWNQVETLKDATAHAEMLALTAAEAAVGDWRLEGCTVYVTKEPCPMCAGALVHCRPDRVVFGIPDPKGGACGGWINLLDSNPPLNHKCAVQGGVLGDACLEQFQSFFGAARAAAKERKRREREETRNAAAD

SEQ ID NO: 995 - protein, 192 aa, unidentified
  source 1..192: note = MG128-13 Deaminase
MTMEITENRDTPLDNEELSFSKEDIKYMKAALKQAEKAIAIGEVPIGAVIVHEGKIIARGYNRRNTDKTTLAHAEIACIRKACKKIGDWRLEGCTLYCTLEPCQMCAGAIIQSRIDRVVIGTTSPKSGCGGTLLNILQNPDFNHQAEVLYGVLREECTEILQRFFKDLRRRNKERKKMLRMQTADALSHPDT

SEQ ID NO: 996 - protein, 149 aa, unidentified
  source 1..149: note = MG128-14 Deaminase
MNAEFDEYFMRMALREAEKAAAAGEVPTGCVVVETPSEETAPPSAARILGRAHNQAEGLVDATAHAEMLALSAAFASRGNWRLTGARLYVTKEPCPMCAGAIVLSRVDAVVWGVSDPKRGGGTVFDIFAHPGINHHPAVVAGVLEDPCR

SEQ ID NO: 997 - protein, 158 aa, unidentified
  source 1..158: note = MG128-15 Deaminase
MDQARKYMKAALREAKKAYALDEVPIGCVIVYEGKIIARGYNRRNTDKLTLAHAELMAIKKASKKLGDWRLEGCTMYVTLEPCQMCAGAIVQARMDEVVIGCMNAKAGSAGSVINLLDMKAFNHQVKITQGVMEEECSTMLSDFFRELREKKKKQAVT

SEQ ID NO: 998 - protein, 172 aa, unidentified
  source 1..172: note = MG128-16 Deaminase
MKKVLSREEKYMKEALKQAKKASDMGEVPIGCVVVLDDRIIGRGYNRRTSDHSTLAHAEIIAIRKACRYVKDWRLDDAEIYVTLEPCQMCSGAIIQARIRKLFIGAMNPKAGCAGSLINIFEVPGFNHYVEVTRGILEDECSAILKDFFVRLRQRLKAEKTSLDLKNDSIYN

SEQ ID NO: 999 - protein, 156 aa, unidentified
  source 1..156: note = MG128-17 Deaminase
MEIKHEFFMREALQQAQLAAAADEVPVGALVVRDGEVLGAAHNQRATLADPTAHAEMIAITQAASALGSWRLSGCTLYVTLEPCSMCAGAIVLARLDRVVYGATDPKAGGVESLYRLLEDSRLKHQAEVVRGVLGPECGAILKEFFQRKRRPPAGE

SEQ ID NO: 1000 - protein, 243 aa, unidentified
  source 1..243: note = MG128-18 Deaminase
MELNALSPEQEQALPVPDQNLTFRPSGEDKSLPSAGQDLAVQIPEQDAERQPSAQAPASHTPEQQKLDLKYMKAALKQAEKALAIGEVPIGAVIVYEGRIIGRGYNRRNTDHTTLAHAEITAIRKACKKMGDWRLEGCTLYCTLEPCPMCAGALVQSRIDRVVIGAASPKSGCGGTLLNILQNEDFNHQAEITAGVMQEACTEILQRFFKALRVRNKAEKKARRAAETAMMAKKDAEAASNTL

SEQ ID NO: 1001 - protein, 159 aa, unidentified
  source 1..159: note = MG128-19 Deaminase
MTSHNDDFFMDIALAEAAKAAEAGEVPIGAVAVDPDGNIIARAHNLVEKENSVSRHAEFEVVRQIENMRHDWRMTGITIYVTKEPCPMCAGMLVNSRISRIVYGLPDPAFGGCGGAVDIPGMPGALWHPEVTGNIKSNESKELVQNFFRRRREAKTKNI

SEQ ID NO: 1002 - protein, 169 aa, unidentified
  source 1..169: note = MG128-20 Deaminase
MSNPDFSKTLASLDKEFHERYLQLAYEEAEKSAAEGEVPAGCVIVQLSDDGLVSKIVARAHNMTEGLKDPTAHAEVLAITQAANAVGDWRLTNCILYVTKEPCPMCAGAIVLARLPLVVWGVSDPKRGGQTEFGIFDHPGINHHPEVITGIMEEECLAQLQAFFKARRK

SEQ ID NO: 1003 - protein, 156 aa, unidentified
  source 1..156: note = MG128-21 Deaminase
MDLLFRDDQAFMREALRLATKAAASEEVPIGAVIAKNGRVIGRGYNQVEMLKDPTAHAEILAVTQAAAAVGDWRLNDCDLFVTKEPCPMCAGAAVHARVRRVVFGCEDIRGGAAGSVINLLQMPQLNHRCDINSGVLADECSVLLQDFFRGKRPQK

SEQ ID NO: 1004 - protein, 236 aa, unidentified
  source 1..236: note = MG128-22 Deaminase
MPDDLPPPPACPFSKVFPSQLQRDDTFFMALAYNEAIDAWREDEVPVGAVIECGGEVIAAAHNQRNGSRDPTAHAEILALTQAAQAMGDWRLNEATLFVTKEPCPMCSGAALMSRLKRVVYAVADPKMGCLGGATDLNALPRVNHHLEISGGVLEAECRELLQAYFRLKRIEDQGALLPRRSRIRMRRHDASVILNGVQDPMGRCPGGWRDPAGCFLLRQACARRVAALSMTMPPQ

SEQ ID NO: 1005 - protein, 212 aa, unidentified
  source 1..212: note = MG128-23 Deaminase
MRFEKKIQSHGRREERVPTGVLEIRVHPARSSDTPSGVENEAPIIDLHSDIYFMGQALREARKAYAAQEVPVGAVVVREGRVIARAWNQVETLKDATAHAEMLALTAAQEALGDWRLEKCTLYVTKEPCPMCAGAIVHCRPERVVFGCPDTKAGAAGGWINLLEANPPLNHRCDVTPGVLGEECLYLLQSFFREARERKKTERLGDSAEPLI

SEQ ID NO: 1006 - protein, 164 aa, unidentified
  source 1..164: note = MG128-24 Deaminase
MLDFSSDEYYMKQALRQANFAAEQDEVPIGAVIVHENEIVGRAYNQVETLRDATAHAEILALTQASAKLERWRLSGCTLYVTKEPCPMCAGAAVNSRIDKIVYGLRDDKGGGCGGAFSITDHEGLLHKVDVMPGFMENESLFLIQDFFKRRRSENKDKKNLLDS

SEQ ID NO: 1007 - protein, 185 aa, unidentified
  source 1..185: note = MG128-25 Deaminase
MENPCPFEKIFPSELNRDEAYYMAHAYNQAIEAWKQDEVPIGAVIEHGGQIIASAHNQSRSTTDPTAHAEILAISQAANYLGDWRLNECRLYVTKEPCPMCAGALVIARIGMVFYGLPDPKMGCVGGATNLGALPLSNHHFESVSGVMQEQNHALLKAFFENRRALNASKRLSSGLDDDLSESPV

SEQ ID NO: 1008 - protein, 167 aa, unidentified
  source 1..167: note = MG128-26 Deaminase
MDPIDPSEFEDLLNPLGDDRERFMQMALREAEIALENGDVPVGAVIVKDGKVIGRGHNQRELLKDPTAHAEMIAITQAAAELENWRLTGATLYVTLEPCPMCAGALVNARLKRVVFGTADPRAGACGSVMNVSQADELNHHVEIVHSVLEERCAAILRDFFKSRRKG

SEQ ID NO: 1009 - protein, 146 aa, unidentified
  source 1..146: note = MG128-27 Deaminase
MGEALRQARKAWKAEEVPIGAVIVLNGQIIARASNQVETLKDATAHAEMLALTQAEAVIGDWRLSECELYVTKEPCAMCAGAIVHTRVKRVIFGCLAPKDGAAGSLMNLLQHPKLNHRCELTSGVRQDECVAMLQAFFRERRGEGL

SEQ ID NO: 1010 - protein, 156 aa, unidentified
  source 1..156: note = MG128-28 Deaminase
MDLLFRDDQALMREALRLATKAAASEEVPIGAVIAKNGRIIGRGYNQVEMLKDPTAHAEILAITQAAATVGDWRLNDCDMFVTKEPCPMCAGAAVHARLRRVVFGCEDLRGGAAGGLINLLQMPQLNHRCDINSGVLAEECSELLQEFFRGKRASN

SEQ ID NO: 1011 - protein, 155 aa, unidentified
  source 1..155: note = MG128-29 Deaminase
MIVFDEEYFMRRALFQAENAAAEGEVPVGAVAVKDNTIIASAYNQVEKLQDATAHAEILVITQAAAALEGWRLNDVDIYVTKEPCAMCAGAMVNSRVRKVYYGMHDPRSGCAGSALDITTFPGMLHSVQVQGGILEDECKSIIQEFFKKARKTID

SEQ ID NO: 1012 - protein, 154 aa, unidentified
  source 1..154: note = MG128-30 Deaminase
MDLSNPLADERWMSEALDQAHAALAHDDVPIGAVVVHEGRVIGRGHNERERLEDPTAHAEVTALRAAAAALGSWRVLDSTLYVTLEPCAMCAGAIVLSRIPRVVFGTPDPKAGAAGSVLDVLADERLNHRPIVVGGVRAEECAGLLQAFFASRR

SEQ ID NO: 1013 - protein, 234 aa, unidentified
  source 1..234: note = MG128-31 Deaminase
MAKGPIDIGEENMALNQEDMASNQEPTEPNRQPRDRKAAETEAARLKGQETRRRNYEKRMEKQRLAALAAEEQRLKQRKRDEGFMREALRQAKKAAAIGDVPIGCVIVCGDRIIARGYNRRNADKSVLSHAEIISIKKACKKMGDWRLEDCTMYVTLEPCPMCAGAIVQARIPRIAVGCMNPKAGCAGSVLDMLHVPGFNHQAEVAEGVLEQECSKLMSDFFQKHRPERLPFIL

SEQ ID NO: 1014 - protein, 161 aa, unidentified
  source 1..161: note = MG128-32 Deaminase
MKDFTSDEFYMGEALRMARRAFSSDEVPIGAVVVRNSEIIARAWNQVETLKDATAHAEMLAITQAESAVGDWRLTDCDLFVTKEPCPMCAGAIVHARLRRVVCGCPDPKGGAAGGLLNILQMPQLNHRCEITGEIRTHECAQILKDFFLARRSQTTNMQSP

SEQ ID NO: 1015 - protein, 165 aa, unidentified
  source 1..165: note = MG129-1 Deaminase
MTHPVPELDQLMQPAIDEARAASTPPRRDIPIGAAVYDEEGRLIASAGNRREADEDPTAHAEILALREAARVRGRWNLTGCTLAVTLEPCTMCAGAIVLARIDHLVVGAMDPKAGAAGSLYDLVREERLNHRVRLTTGVREIECAQMLRGFFRDLRERRKGLRAG

SEQ ID NO: 1016 - protein, 154 aa, unidentified
  source 1..154: note = MG129-2 Deaminase
MSDEAFMQQALALAREAEALGEVPVGAVAVHDGRPIGTGFNRREVDRNPLAHAELLALDEARKALGVWRLTGVTLYVTLEPCAMCAGALVQSRVTRLVFGAMDPKAGAVGSLYNLAEEPRHNHRLQVTSGIMADESRLLLKGFFERLREKRRDK

SEQ ID NO: 1017 - protein, 174 aa, unidentified
  source 1..174: note = MG129-3 Deaminase
MSEPHPFDAAMREALSLAAEAAAAGEVPVGAVAVHGGEVVGRGRNRREEDRDPCAHAELLAIREAARTLGRWRLTGVTLVVTLEPCAMCAGALVLARVDRLVYGAPDPKAGAVGSLMDLSSDPRLNHRFPVERGLRADECGEQLRAFFRSRRATSGASGENSGSSALGSGGEIG

SEQ ID NO: 1018 - protein, 150 aa, unidentified
  source 1..150: note = MG129-4 Deaminase
MREALALARDAGARGEVPVGAVAVLEGRVVGRGANAREFGRDPTAHAELLAIRDAARTLGRWRLTGVTLVVTLEPCAMCAGAMVLARIDRLVYAANDPKAGAVGSLLDLSQDPRLNHRFEVVRGVLGDEAGELLRSFFRARRGGGNGSEG

SEQ ID NO: 1019 - protein, 143 aa, unidentified
  source 1..143: note = MG129-5 Deaminase
MTARLTSASALRMAFPLPAPMRRALDLAAEAAAEGEVPVGAVITQGERIVAEARNSMRGLLDPTAHAEMVAIRVAAEALGQARLDGCTLWVTLEPCAMCAAAASIARLDAVRYAAEDPKAGVSSTAPGSSPSPPAIIVPTSSA

SEQ ID NO: 1020 - protein, 159 aa, unidentified
  source 1..159: note = MG129-6 Deaminase
MTAAEDLRWMHQALDLAAEAARAGEVPVGAVAVHDGEAVGRGRNRRETTNDPFAHAEMEALAAAVKALGRWRLTGVTLYVTLEPCSMCVGAMLLGRIDRVVWGASSPKAGALGGLFDLTREAHNQRFEKQGGVAADECGDLLRRFFGDLRAAVEDERGL

SEQ ID NO: 1021 - protein, 177 aa, unidentified
  source 1..177: note = MG129-7 Deaminase
MSTGTNVHPFDAAMQEAIALADEAARAGEVPVGAVAVLDGKVVGRGRNRREEDRDPCAHAELLALRDAARTLGRWRLTGVTLVVTLEPCAMCAGALVLARVDRLVFGALDPKAGAVGSLMDLSADPRLNHRFPVDRGVRGEECAAQLRAFFRLRRASPGGGGENSGSSELGSGGEIG

SEQ ID NO: 1022 - protein, 170 aa, unidentified
  source 1..170: note = MG129-8 Deaminase
MESSYNTNMNDEAYMQIALEEARKAAEAGEVPIGAVVVYEPIDSGTRRSLAEPRIIARAGNRRERAKDPAGHAEFVAMIEASRELDAWRLSDCTVYVTLEPCVMCAGLMYQARVRRCVYGASDPKAGALGTLYQINEDERLNHTFEVTAGVLADECAEELRKFFANKRKK

SEQ ID NO: 1023 - protein, 151 aa, unidentified
  source 1..151: note = MG129-9 Deaminase
MDLPHEHFLDLALEEARRAAGEDEVPVGAVAVFEGAVVGRGRNARERARDPLAHAELDALREASRNLGRWRLSGVTLYVTLEPCAMCAGAMVNARIERLVYGADDPKAGAVRSLYAICTDDRLNHRVEVIGGVRAAESSELLKEFFRGKRK

SEQ ID NO: 1024 - protein, 149 aa, unidentified
  source 1..149: note = MG129-10 Deaminase
MGEALDVARRAASMGEVPIGAVVVRDGAVLATAHNRREIDRDPTAHAELLALRQAAGTLGDWRLDGATVYVTLEPCAMCAGAMVLARIAACVYACPDPKGGFLGTLGDLSQVDGLNHRFGVRAGVRADEASEMLKSFFRGLRGGREGVD

SEQ ID NO: 1025 - protein, 158 aa, unidentified
  source 1..158: note = MG129-11 Deaminase
MATEPDETYMREALELAARAGALGEVPVGAVAVFEGRVIGRGFNRREVDRDPFSHAELLALGEASRALGAWRLSGVTLFVTLEPCAMCAGAMVQARVDRLVFGTRDPKAGAVGSLYNLAEEPRHNHRVAVTEGVLAEESGTILSGFFRSLRERRRTSE

SEQ ID NO: 1026 - protein, 141 aa, unidentified
  source 1..141: note = MG129-12 Deaminase
MDFMSTALELARAAGQMGEVPVGAVAVSGGVIIGRGHNRRETDHDPFAHAELLAMREAAQHLRSWRLTDVTVYVTLEPCAMCAGAMAQARLGAVVFGADDAKQGRADLLVGHNHTVKVTRGVEAEQASVLLKEFFARLRAT

SEQ ID NO: 1027 - protein, 167 aa, unidentified
  source 1..167: note = MG130-1 Deaminase
MSVESPVEGVDTADAADAVWMAHALDEARAAGAAGDVPVGAVVVHEGVIVGRGRNRREVDRDQTAHAELVALREAAREPGHWRVEAALFVTQKPCPMCAGAIVNARVRRLVFGCLNPKAGAVTTLYQIPTDPRLNHHVEVVGGIRSEECAALLRAFFAELRRGPEYR

SEQ ID NO: 1028 - protein, 193 aa, unidentified
  source 1..193: note = MG130-2 Deaminase
MSLAGSRVISMSLERDTETADHAFMGEAIEAARKAGAAGDVPVGAVIVIDDEIIAHGHNRRQVSSDPTAHAEIEALRAASRIVGNWRIEGTLYVTQEPCPMCAGALVNARVKRLVYGCSNPKAGSVHTLYEIVTDVRLNHRMEVTAGVRQEECADLLRQFFADLRRNGRTGSHAGDETGHGTDGDPGDSPGGH

SEQ ID NO: 1029 - protein, 156 aa, unidentified
  source 1..156: note = MG130-3 Deaminase
MTAAETWMREAIALAAAAAGAGEVPIGCVVVHDPTGRIVGRGANRREADHDPTAHAEILAMREAGRTLGHWRLIDCTLVVTLEPCPMCAGAIVNARVPRLIYGCADPKAGAVRTLFQLCNDDRLNHRVDVSAGVLAEQCAEQLKAFVRAQRALGKK

SEQ ID NO: 1030 - protein, 189 aa, unidentified
  source 1..189: note = MG130-4 Deaminase
MTSQEWMHEAINCARQALAADEVPIGCVIVHLPTAQIIGRGFNQRETAHDPTAHAEILAMREAGAALNHWRLLDCALIVTLEPCPMCAGAIVNARIPKLIYGCDDPKAGAVRTLYNLVEDHVRFTGSPRGKKILDNWDHLIARFVKVMPIEYKRVLERRRSTTRPRSLLIGPADRSESGPLHTRGVANG

SEQ ID NO: 1031 - protein, 216 aa, unidentified
  source 1..216: note = MG130-5 Deaminase
AKPAYGVYLYRGFESLPVRNKHSIDFGSVAQWIEHRSTEPGVRGSTPLGSASRRQHMTSPTMTDDQWMHVALSEARAAAATGDVPVGAVIVAADGTLLGRGRNRRELDKDPTAHAEIVALREAAHALGMWRVDATIYVTQEPCPMCAGALVNARIARLVYGCPNPKAGAIASLFSIVSDPRLNHRIDVTSGVLSTECAAVLSQFFAELRRGPTYGT

SEQ ID NO: 1032 - protein, 156 aa, unidentified
  source 1..156: note = MG131-1 Deaminase
MDADDERWMRIALDEADSAAAKGEVPVGCAIVSATGELLASGHNLRETEEDPTAHAEIVAMRIAARKLDTWRLESTTLYVTLEPCVMCAGAMVNARVGRVVYGCLDPKAGAVTTLFTIGADTRLNHRFPVTGGVLADDCAERLRRFFSALRAQGKK

SEQ ID NO: 1033 - protein, 148 aa, unidentified
  source 1..148: note = MG131-2 Deaminase
MRAALAEADAAAAIGEVPVGCVLVGADGAELARGHNLREATQDPTAHAEMIAVRAAAAKIGSFRLEGVTAYVTLEPCPMCAGALVHARVAHVVYGCDDPKGGAVTSLYAVGVDGKMNHTFTLTRGVLADESAARLRTFFAGLRALGKK

SEQ ID NO: 1034 - protein, 164 aa, unidentified
  source 1..164: note = MG131-3 Deaminase
MKKDRVFMAEAMALADRAGELGEIPVGAVIVRKGRVIARAFNRREAWQDPTAHAELIAIRRAAEALGEWRLSECTLFVTLEPCPMCAGTIVNSRVGRVVYGAPDPKAGAVRSVYAMLEDPRLNHRCAVARTMAAECSEQLTAFFVALREGRVARAGRPAGSEEE

SEQ ID NO: 1035 - protein, 239 aa, unidentified
  source 1..239: note = MG131-4 Deaminase
MPSVLEDSGTHDIRDIPQHFIGCRSRRAHQTCPKLVHALPVSLSRFAASICGIRLCFACLVRPCSRYVSPFSLRRFLRGPCYSPAHMATTTDDQHWMQIALEEADAAAATGEVPVGCVLVDFHGREISRGHNGRETLADPTAHAEMIAIREASARVLGWRLDKVTAYVTLEPCAMCAGALVHARVARVVYACADPKGGAVDTMFGIGRDARLNHRFDVTAGVLGEESAMRLRRFFAGLR

SEQ ID NO: 1036 - protein, 156 aa, unidentified
  source 1..156: note = MG131-5 Deaminase
MDVTQDVAFMLEALAEADRAAEIGEVPVGAVMVVGNAIVARGHNLRESAADPTAHAEMIAIRECAKTRGDWRLDDATLYVTLEPCPMCAGALVHARVKRVVYGCDDPKAGAVKTLFSIGNDPRLNHRFELTSGVRAEECASKLQAFFQRLRAQGKK

SEQ ID NO: 1037 - protein, 174 aa, unidentified
  source 1..174: note = MG131-6 Deaminase
MSTAASFPLPAESAEPPATPALTVAPEHVAYMRQALEAAEAATQRGEVPVGAVVVAGGAVIAVAHNERETGNDPTAHAEVLALRRAAAALGSWRLTEADLYVTMEPCPMCAGAIVNARVRRVYYGCDDPKAGAVRSLYRILDDRRLNHRVEVVPGVLSVEAAGLLRAFFGRLRR

SEQ ID NO: 1038 - protein, 178 aa, unidentified
  source 1..178: note = MG131-7 Deaminase
MTTAAAAEPLSSSTLAEGGSSVGERELSFMRRALAAAELAGGRGEVPVGAVVVVGDEVVAIAHNERETGGDPTAHAEILALRRAAAALGRWRLTDADLYVTMEPCPMCAQAISFARLRRLYFGCDDPKAGAVRTLYSLVEDSRLNHRVEVFPNVLAAEGAALLRGFFSRLRQPEARER

SEQ ID NO: 1039 - protein, 143 aa, unidentified
  source 1..143: note = MG131-8 Deaminase
EALHEAELAAELGEVPVGCVLVRAGEVIARGRNLREAARDPSAHAELVALRSAAARLGSWRLVDVTCYATLEPCPMCAGALVNARIARLVYGCDDPKAGAVRTLYSIGQDPRLNHRFEVSAGVLAEACAERLSSFFAELRSRR

SEQ ID NO: 1040 - protein, 168 aa, unidentified
  source 1..168: note = MG131-9 Deaminase
MSVTRTAELPLDATPEAVAVDELHMRTALAAAERATLSGEVPVGAVVVLRGEVIAVAHNQRETNNDPTAHAEIVALRAAAAALNSWRLVDADLYVTMEPCPMCAGAIVNARVRRVIYGCDDPKAGAVRTLFQLLDDQRLNHRVEVVSGVLAAESSALLKSFFSRLRLR

SEQ ID NO: 1041 - protein, 159 aa, unidentified
  source 1..159: note = MG132-1 Deaminase
MQPTDPFHLQHMELALEEAGLAFAQDEVPIGAVIVHLEKGIIARAHNQREMLQDPTAHAEMIAISHAAGALGSWRLEDTILYVTLEPCPMCAGAIVQARVPFVVYGANDAKAGACHTLYEITNDPRLNHRCHVLGGVLSERCAAILGEFFAAKRRLGKK

SEQ ID NO: 1042 - protein, 171 aa, unidentified
  source 1..171: note = MG132-2 Deaminase
MIDPFSPFDLTFTDPHHPFHLHHMELALEEAAAADREDEVPVGCVIISPERGIIASAHNQREQLTDPTAHAEMIAITQAAASLKSWRLEQCILYVTLEPCPMCAGAIVQARIPVVAFGCTDPKAGACTTLYQIASDPRLNHRARIIGGIQAARCAAMLSNFFQRKRAMGKK

SEQ ID NO: 1043 - protein, 149 aa, unidentified
  source 1..149: note = MG132-3 Deaminase
MLLALDQARIALAHDEVPIGAVLYHLPTRNIIGQAHNRRILDADPPAHAELLAIRQGAQTLGDWRLTDTILAVTLEPCPMCAGAIVNARIPQLVYGCADPKAGAVQTLYQLCSDPRLNHRVQLTAGVRSDDCSALLTSFFAAKRAMGKK

SEQ ID NO: 1044 - protein, 165 aa, unidentified
  source 1..165: note = MG133-1 Deaminase
MNGPRAHEIDDRMMGAALDAARAALSIGEVPIGAVVYRGEDVLGTGHNRRETDADPSAHAEVLAIRAAAHAIGDWRLEGCSIAVTLEPCPMCAGLIVNARLERLVYAAADPKAGAVETLYGLCADARLNHRASEIRAGVREAEAAGLLRGFFRDLRARGDGPPDA

SEQ ID NO: 1045 - protein, 147 aa, unidentified
  source 1..147: note = MG133-2 Deaminase
MMRRALDLAAAAAEEGEVPVGAVIYDTQTGETLGEAANRREADRDPSAHAEFTAIRRACSKINDFRLNRCSLAVTLEPCPMCAGLIVNARVGRVVYGADDPKAGAVRSLYEILSDARLNHRCEVIPGVLADESADLLRSFFRGLRAR

SEQ ID NO: 1046 - protein, 175 aa, unidentified
  source 1..175: note = MG133-3 Deaminase
MHQVRLQTERHPDVTDVDIEMMQRAIKLAKKAATLGEVPVGAIVYKGSKVLAEGYNVRESASDPTGHAELIAISKAGKALGDWRLTDCSLAVTLEPCPMCAGALVNARLGRLIYGAADPKAGACHTLYEIPIDDRLNHRVAMIGGVMANECRALLRDFFQQRRQINRDTRNARSA

SEQ ID NO: 1047 - protein, 167 aa, unidentified
  source 1..167: note = MG133-4 Deaminase
MRQPEPPQPTTTDIEMMERAIELAQQSADAGEVPVGAIVYNTQTGEIVAQAHNTRDMHNNPAGHAEFSAIQSACNSIGDWRLNDCTLVVTLEPCPMCAGLIVNARVGRLIYGASDPKAGAVRSLFELCDDTRLNHRCEIHTGVLGDRCSDQLRTFFRDLRAQRKSNG

SEQ ID NO: 1048 - protein, 180 aa, unidentified
  source 1..180: note = MG133-5 Deaminase
MVGWLSRVLGMRRGAAAPGAPASATSTDVNMMGRALELARQAAAIGEVPVGAVVYETGSGRILGEGFNRREIDHDPAAHAELTAIRAAAAARGDWRLNDCTLVVTLEPCAMCSGLIVNARIGRLVYGAADAKAGATESLYRLTSDPRLNHRVEPVAGVMAEECGALLKEFFRGLRAGGRR

SEQ ID NO: 1049 - protein, 175 aa, unidentified
  source 1..175: note = MG133-6 Deaminase
MQQLKLVQSDSVRATEVDVDMMKRAIELANLAAAMEEVPVGAVVYRGNKIIAEAHNNREQNADPTGHAELLAIRLASEKLDSWRLNDCALAVTLEPCPMCAGAIVNSRISRVVYGATDPKAGACESLYEILSDDRLNHQVEMVSGVLASECSKLLKDFFKERRKINRERRLRNAS

SEQ ID NO: 1050 - protein, 172 aa, unidentified
  source 1..172: note = MG133-7 Deaminase
MLARLKNLFTKPKQANDATEIDDRMMVRALELARDAAGAGEVPVGAVVYVNETGEIIGEGANRRETDNDPSAHAEHIAIVRAAERLGDWRLNHCTVVVTLEPCAMCAGLIVNARLGRVVYGADDPKAGACRSLFEIADDPRLNHRAQIIAGVRHDECAQVLRTFFRGLRAKG

SEQ ID NO: 1051 - protein, 168 aa, unidentified
  source 1..168: note = MG133-8 Deaminase
MADAVDEFDLTMMRRALAQAERAAAMHEVPVGAVVYELSSRAVLAEAHNRREIDADPTAHAEMLALRAAARRRGLWRLDGCAIAVTLEPCPMCAGALVNSRIDRLVYGAADPKMGCVETLYGLCTDERFNHRLEVRGGVLAEPCAAVLSEFFKARRGADKAPKPKPGT

SEQ ID NO: 1052 - protein, 162 aa, unidentified
  source 1..162: note = MG133-9 Deaminase
MTAGAPTDLDRAMMRRALDRARDAMAMDETPVGAVVYETATGRILAEAHNRREADDDPTAHAELIAIRHAARAVGDWRLNDCTLVVTLEPCAMCAGAIVNARVGRLVYGASDPKAGAVESLYRLCQDARLNHRIEPIGGVDAEECGGLLREFFRAKRSRTDD

SEQ ID NO: 1053 - protein, 152 aa, unidentified
  source 1..152: note = MG133-10 Deaminase
MMARAIELAQHAASIGEVPVGAVVYCNTEVLGEGYNRRESDRDPTAHAEMLALRQAAEQRGSWRLEDCSLAVTLEPCPMCAGAIVNARIARLVYGAADPKMGCVQTLHQLCSEQRFNHRVQLIACIEAERCGQLLKEFFQARRNGGNKGKPS

SEQ ID NO: 1054 - protein, 172 aa, unidentified
  source 1..172: note = MG133-11 Deaminase
MDLTDLDTRMMRLALEQARAASDAGEVPVGAVVYRGEEVLAKAHNMREAWADPTAHAELIALREAAKTIGTWRLDGCRLAVTLEPCPMCAGALVNSRLEAVVYGITDPNMGCVESLHRLLDTRAFNHRVSWQGGVLADASLALLQGFFKARRGKDKPPKPTSQTGQADATRP

SEQ ID NO: 1055 - protein, 161 aa, unidentified
  source 1..161: note = MG133-12 Deaminase
MTADPAKVCARDEQAMSRAIELAREAEAMGEVPVGAVVYRTETGETLGEGYNRRETDDDPTAHAEILAIRQAATKIGDWRLNECTLVVTLEPCVMCAGAIVNARVGRLVYGAIDPKAGGVESLYAIPSDNRLNHRPTILPGLMAEACGELLRAFFRSRRGK

SEQ ID NO: 1056 - protein, 180 aa, unidentified
  source 1..180: note = MG133-13 Deaminase
MIRFRSDITRRNERIRARQRSWSATNHAMMGLALDLAGQAAAIGEVPVGAVVVHRGRVVGEGFNRRESEADPTSHAEIEAIREAATALGDWRLSECTLYVTLEPCPMCAGAIVNARVGRLVYGATDPKAGAVASLYQLCSDARLNHRVEVLGGVRARECGLVLRRFFRGLRRRRRASRRR

SEQ ID NO: 1057 - protein, 168 aa, unidentified
  source 1..168: note = MG133-14 Deaminase
MMAPPEQPAAPLPPTEATETDLAMMRRALDLARSAGEAGESPVGAVVYETATGRILAEAHNTREADKDPCGHAELIAARAAAKALGDWRLNGCTLVVTLEPCAMCAGMIVNARFGRVVYGASDPKAGAAESLYALTQDARLNHRVRPVAGVLAGESAQMLREFFRQRR

SEQ ID NO: 1058 - protein, 166 aa, unidentified
  source 1..166: note = MG134-1 Deaminase
MLTSDQEYMNLALELGLQAAREGDIPVGALVVDPCGEIIGRGRNRRRIEHDPTAHAEVVALREAARNLGVWNLNGCSLYVTLEPCPMCAGALVQARVSRLVYGCTDPKAGACGTLYDLTRDTRLFHRLQVVPGVMEQECRALLQDFFRECREKNRTFGRLLDGRNN

SEQ ID NO: 1059 - protein, 158 aa, unidentified
  source 1..158: note = MG134-2 Deaminase
MTDDERFMGYALARAEAAAARGDVPVGAVVVRDGAVVGVGENRREIEADPTGHAEIVALRDACRSAGRWRIDGATLYVTLEPCPMCAGAIVNARVARLVYGADDPKAGAVRSLYEICTDPRLNHRVELCPGVLAEPAAGLLRDFFRRARARAKLGQGV

SEQ ID NO: 1060 - protein, 166 aa, synthetic construct
  source 1..166: note = MG134-3 Deaminase
MGDSDPTAADLSFMDAALDLARRAADAGDVPVGALVVLDGRIVGIGGNRREVDADPSGHAEIVALRDAGKSVGRWRVDGATLYVTLEPCPMCAGAIVSARVARLVYGADDAKAGAVRTLYQICSDPRLNHRVEVVAGVRAEESRALLRDFFAQARQRRRPRPGGAR

SEQ ID NO: 1061 - protein, 177 aa, unidentified
  source 1..177: note = MG134-4 Deaminase
MAADLEYMRLALELAAEAGERGDVPVGALVVREGRILGTGFNTREREHDPTGHAEVVAMREACRQARRWRLDGATLYVTLEPCPMCAGALINTRIARLVYGAHDPKAGAVRSLYQLCEDPRLNHRIEVVGGILAEDGAAQLKQFFRAARARARRERAAGNEAPRWERGEQERRGDQE

SEQ ID NO: 1062 - protein, 156 aa, unidentified
  source 1..156: note = MG135-1 Deaminase
MSHSDELFMEEALREAQRASALGEVPVGAVVVRDGHIVGRGCNRPVTAHDPTAHAEIQALREAGHVVGNYRLNDCDLYVTVEPCAMCAGAITHARIRRLIYGAEDPKAGAVHSMLQVLNHPKLNHQVEVTCGVLAARCMDLLQTFFRTKRTTAENH

SEQ ID NO: 1063 - protein, 169 aa, unidentified
  source 1..169: note = MG135-2 Deaminase
MLIASHCISLFAMSLSDEFWMEEALREAQRALALGEVPVGAVVVSDGRIVGRGCNRPLSANDPTAHAEILALREAGTTIGNYRLLDCDLYVTVEPCPMCAGAITHARVRRLVYGAEDAKAGAVRSMLQVLNHPQLNHKVEVTSGVLAARCMQLVQSFFRERRAEPDNNR

SEQ ID NO: 1064 - protein, 155 aa, unidentified
  source 1..155: note = MG135-3 Deaminase
MEPTDELWMAEAIREAHLAQAGGEVPVGAIIVCGGRIAGRGGNRNIRDSDPTAHAEIIALREAGHHMGNHRLPDCVMYVTIEPCAMCAGALMHARLARLVYGADDPKAGGVHSVTGVLNHPRLNHHMQVTSGVLAARSSDLLQAFFREKRVKTAE

SEQ ID NO: 1065 - protein, 142 aa, unidentified
  source 1..142: note = MG135-4 Deaminase
MEEALREAGRALHAGEVPVGTVIVHENKIVGRGFNRSISDADPTAHAEVIALREAGKNLGNYRLRGCELFATIEPCAMCAGAMVHARIKRLIYGADDPKAGAVKSVMQVINHADLNHRMEVVGGVLAGRSSQLLQEFFRSRR

SEQ ID NO: 1066 - protein, 155 aa, unidentified
  source 1..155: note = MG135-5 Deaminase
MADPVTEQSDELWMEEAIRCAQRALEIGEVPVGAVVVCDGRVVGRGWNRNLADNDPTAHAEIVALRDAGATIGNHRLVDCELFATIEPCTMCAGALVHARIRRLVYGAYDLKAGAVRSVLQVLNHPQLNHRMDVRGGVLAGRSAEILQEFFKKRR

SEQ ID NO: 1067 - protein, 174 aa, unidentified
  source 1..174: note = MG135-6 Deaminase
MSGSKPRARPPARQSSQAVPESHPQNPPDELWMEEALRCAQRALEANEVPVGAVVVHDGQIVGRGWNRNITDSDPTAHAEIIALREAGATVGNYRLEHSELFVTIEPCAMCAGALTHARVRRLVYGSDDPKAGAVRSVMPTLNHPQLNHKVEVRGGVLAGRSAELLQSFFRSRR

SEQ ID NO: 1068 - protein, 157 aa, unidentified
  source 1..157: note = MG135-7 Deaminase
MMSPDEQWMEVALQQAAEAARLGEVPIGAVVVCDGAIVGRGANRNLNDADPTAHAEVVALREAARTLGTQRLVACEMFVTIEPCAMCAGALTHARIRRLVYGADDPKAGAVHSVMTVLNHPQLNHKMEVLGGVLQERCGELVRDFFRSKRAESKIKS

SEQ ID NO: 1069 - protein, 142 aa, unidentified
  source 1..142: note = MG135-8 Deaminase
MEEALRCAQRALESGEVPVGAVVVHAGRIIGRGWNRNIGEFDPTAHAEIAALREAGATLGNHRLGDCDLFVTIEPCAMCAGAMTHARIRRLVYGAEDPKAGAVRSVMQVLNHKHSNHRIEVRSGVLAGRSAELLQTFFRNRR

SEQ ID NO: 1070 - protein, 172 aa, unidentified
  source 1..172: note = MG136-1 Deaminase
MTASTESLCLPDRRREEHYMRLALDQARQAEKADEIPVGAVVVIGGRVIGRGFNSPIGRNDPTAHAEILALRESALTVDNYRLEEATVFSTLEPCVMCAGALVAARVRRLVFAARDIRFGAVRSKFRLADSELLNHRVQVEEGLLAAECGDLVRAFLQRARERPLPGLDGSA

SEQ ID NO: 1071 - protein, 150 aa, unidentified
  source 1..150: note = MG136-2 Deaminase
MRQALAAAHEAGERGEVPVGACIVAGDVILAVAGNRTRTDSDPTAHAEIVALRNAAKSGNYRLTDARVYSTIEPCVMCAGALIQARVSRLVYGARDERAGAVESHFRVCDTDFLNHRIAVTAGVLEAECRELMQRFFRARRGNQGMRAEG

SEQ ID NO: 1072 - protein, 165 aa, unidentified
  source 1..165: note = MG136-3 Deaminase
MKAAEERENAAQWMRQAVAAAHGARERGEVPVGACIVDGETILAVAGNRTITDQDPSAHAEIVALREAARKIANYRLTNAVVYSTIEPCVMCAGALIQARVKRLVYGARDERAGAIESRFSVCNTDFLNHRIEVTAGVLENECREIMQEFFRARRCGTAGAKLEG

SEQ ID NO: 1073 - protein, 252 aa, unidentified
  source 1..252: note = MG136-4 Deaminase
MALLTGRLPPAVLSGCWICLRRVDCCLFDFLRWSLDVKSVWSASARLGRGTPEIDNNTRHAPALNYVGFSCLTCLDERPIVAVRLFEGTTVVVNTAAEIELDERWMRHALAAAGEARERGEVPIGTCIVSDDKLIAVAGNRTRTDCDPTAHAEIVALREAAQTLGNYRLTAVDVYSTIEPCAMCAGALIQARVRRLIYGAADERAGAVVSRFRICDTDFLNHRIEVRSGVLEPECRALMQEFFKTRRGRIVD

SEQ ID NO: 1074 - protein, 124 aa, unidentified
  source 1..124: note = MG136-5 Deaminase
MIAAACNRTITNNDPTAHAEILALRAAAETIGNYRLTGVTVYSTIEPCAMCAGALVNARVGRLVYGADDERFGAVKTNFGIGVTNVLNHQIKIEGGVMADECRQVMQEFFRNKRRKLDNEGASN

SEQ ID NO: 1075 - protein, 148 aa, unidentified
  source 1..148: note = MG136-6 Deaminase
MSGDVFMREALALACQAEANGEVPVGAVVVIGGEVRGRGSNAPIRLNDPTAHAEMLAIREAAAAIGNYRLEGAILYSTLEPCVMCAGALVAARVGRLVFGARDLRFGGGRSKFRLADSELLNHRLEIVEGVLAADCLALVKRFFEQRR

SEQ ID NO: 1076 - protein, 127 aa, unidentified
  source 1..127: note = MG136-7 Deaminase
PIGAVIVDANDKLLASASNRTITNVDPTAHAEILVLRTAALQVGNYRLSGTTVYSTIEPCAMCAGALVNARVARLVYGAADERFGAVETHFGICDSSALNHRLEISSGIHADECRRLMQEFFRSRRV

SEQ ID NO: 1077 - protein, 110 aa, unidentified
  source 1..110: note = MG136-8 Deaminase
MREALKCASEAAELGEVPIGACLVDESGVMIASASNRTIIDSDPTAHAEILVLRQAATSIGNYRLTGMTLYTTIEPCVMCAGALVNARIKRLVFGARDERFGAVETRFRL

SEQ ID NO: 1078 - protein, 153 aa, unidentified
  source 1..153: note = MG136-9 Deaminase
MITTDIDEKWMRAAIEAARSAADLGEVPVGACLVDAGGNLLSIASNRPITNHDPSAHAEMLALREAAAKVENYRLTGVTAYSTIEPCVMCAGALVNARVARLVFGSHDERFGAVESKFRICDSELLNHRIEIVPGVLADECRALIQEFFRARR

SEQ ID NO: 1079 - protein, 164 aa, unidentified
  source 1..164: note = MG136-10 Deaminase
MNELDEIWMREAIRAARAAETLGEVPIGACLIDAEGALLAVAGNRTITATDPTAHAEILVLREASALIHNYRLVDTTIYTTIEPCTMCAGALVNARIRRLVYGAADERFGAVRTLFNLCDNQALNHRIEIVAGVLEAECRALVQNFFRKKRDFQKSQKINADQT

SEQ ID NO: 1080 - protein, 142 aa, unidentified
  source 1..142: note = MG136-11 Deaminase
MWRTLHLAREAEKLGEVPIGAIIIDGKGKILAATSNRTITDSDPTAHAELMAIRTAGMRIGNYRLNGTTMYSTIEPCVMCAGAIVNARVERLVFGAHDERFGAVETLFKIGSGRKLPPSAAGFLSRPPRPLRPLTQDPEARA

SEQ ID NO: 1081 - protein, 158 aa, unidentified
  source 1..158: note = MG136-12 Deaminase
MSNYSGSAAAGDEAWMRRALGLARRAAEEGESPVGAVIVGADGRLLAEAHNAPIGMHDPTAHAEIVALRAAARALGNYRLNGTTMYVTLEPCVMCAGALVHARVKRLVFGARDLRFGGVRSKFRLADSDLLNHRLEIEEGPMAAEATALLEEFFRARR

SEQ ID NO: 1082 - protein, 167 aa, unidentified
  source 1..167: note = MG137-1 Deaminase
MSFNVLTQHHFSSDDEKWMRLALEQASFAEMQGEIPVGAVIVSQNQVIGVGYNAPITSQDPTAHAEIVALRDACARIQNYRLPDDAVLYVTLEPCTMCVGALIHARIHKVIFATYEPKAGSLLSARQLLKNNGYYNHVFEYQDGCLQQEASALLSTFFKKRRAEKKQ

SEQ ID NO: 1083 - protein, 178 aa, unidentified
  source 1..178: note = MG137-2 Deaminase
MAVLTNPMTGADETDDYWMNRALALAAQAAESGEVPVGAVIVMDGREVGAGFNGPIGQCDPTAHAEIRAIRDAGARAGNYRLPGATLYVTLEPCTMCVGAIVHARISRLVFGTLEPKAGAVESVRQTLQDDHFNWQVAVTGGVMASQCKDIIQRFFADRREKHRLRKQKSSGKEQQPL

SEQ ID NO: 1084 - protein, 157 aa, unidentified
  source 1..157: note = MG137-3 Deaminase
MIRSDEFYMHRALDQAHLAFVEGEVPVGAVVVDAQGTIIGAGRNSPVASCDPSGHAEIRALREAGQQLGNYRLEGCTLFVTLEPCMMCAGAMVHARLARLVYGAAEPRTGMVESKANLLAQPWFNHQVAVTRGVLAAPAKKLLKQFFATKRESITQR

SEQ ID NO: 1085 - protein, 167 aa, unidentified
  source 1..167: note = MG137-4 Deaminase
MSELPKNDEYWMARALVLAERAASIGEVPVGAIVVRHGQELGVGYNAPITGCDPTAHAEIRALRDASARAGNYRLTGATLYVTLEPCTMCVGAIVHSRISRLVYGAREPKAGAVESARCTLDEAHLNWQVDAEGGVLEGECGQIISDFFSRRRAEIRRRRKQNSGKE

SEQ ID NO: 1086 - protein, 166 aa, unidentified
  source 1..166: note = MG137-5 Deaminase
MGKVQIIDRSQDARFMRLALELAARGAALGEVPVGAVLVRDGEVVGEGFNCPISAHDPSAHAEMVAIRAAAKAAGNYRLPGSTLYVTLEPCSMCAGLIVHARISRVVYATSEPKAGVVISRGRFFEQDFLNHRVLAEGGVLAQESAELLSGFFQARRRGASQPVSG

SEQ ID NO: 1087 - protein, 167 aa, unidentified
  source 1..167: note = MG137-6 Deaminase
MSEVTAEDEYWMNRALQLAGEAAAKGEVPVGAVVVLDGGEIGAGFNAPISGCDPTAHAEIRALRDAAARVGNDRLPHATLYVALEPCTMCVGAIVHGRISRLVYGASEPKAGAIESARRTLEEPHLNWGVTAVGGVLSDQCSQVISEFFSRRRAEIRRLRKQNSGKE

SEQ ID NO: 1088 - protein, 161 aa, unidentified
  source 1..161: note = MG137-7 Deaminase
MDDVTAMRRALAQARLAFDAGEVPVGAVVVQGDEVVAEGFNQPIGRLDPSAHAEMVAIRAAATAIGNYRLTGTTLYVTVEPCTMCAGLLVHSRIQRLVFGAPEPKSGAVVSNLCLFDHGPYNHRPDVTGGVLESECSELMSRFFTERRERRKALRRAGRPE

SEQ ID NO: 1089 - protein, 173 aa, unidentified
  source 1..173: note = MG137-8 Deaminase
MISDDAGELDDIAAMRLALEQARLAAGEGEVPGGAGVVLEGKVIGTGYNGPIGGLDPSAHAEMRAIRQACLTVGNYRLPGATLYVTVEPCTMCAGLLVHSRISRLVYGAAEPKSGAVVSNLKLLDNGPYNHRIEVAGGVLADECSALMSEFFARRRARKKALKQSTGPAKPAS

SEQ ID NO: 1090 - protein, 179 aa, unidentified
  source 1..179: note = MG137-9 Deaminase
METTSVMTPDVDDERWMRAALALAERAAALGEVPVGAVVVRDGEVIGEGWNQPISGQDPTAHADIMALRDAARRVGNYRLVDADLYVTIEPCTMCAGAIVHARIRRVVFGASEPKAGALISRQSLLDEPWLNHRVSWTGGVLAEHCSERISAFFRARREERRRQRQLQSPSSEGGSGLG

SEQ ID NO: 1091 - protein, 174 aa, unidentified
  source 1..174: note = MG137-10 Deaminase
CRVSHQLLLSGNNPLTLASENDSAWMAQALQLSARAAELGEVPVGALVVLNGEIIGQGYNQPIASHDPTAHAEIMALRDAAQRVGNYRLPEAELYVTLEPCMMCSGAIVHARIARVIYGATEPKAGAVDSQLNSFSLAHINHRPLVTSGVLADTCSQQLSDFFKARRAAKRAQS

SEQ ID NO: 1092 - protein, 158 aa, unidentified
  source 1..158: note = MG137-11 Deaminase
MQEALLEAAKAEALSEIPVGAVVVLEGEIIGRGYNCPISSVDPTAHAEIQALRDAASRVGNYRLPGATLYVTLEPCSMCAGAIVHSRVERVVFAATEPKSGVVESQGRFFDAPFLNHKVQCCGGVLQEAASQQISQFFQYRREQKKRLKRLSSPSREE

SEQ ID NO: 1093 - protein, 164 aa, unidentified
  source 1..164: note = MG137-12 Deaminase
MPAVTGIAVSPMSEARWMEEALALAEQAAALGEVPVGAVIVRGGGVIGRGFNRPISSSDPTAHAEIEAIRDAARTVGNYRLPESEMYVTIEPCTMCTGALVHARIARLIYGAPEPRAGAVCSQSRLLDAGHFNHRVSYEGGLLEARCAALLQRFFQARRAARQP

SEQ ID NO: 1094 - protein, 155 aa, unidentified
  source 1..155: note = MG137-13 Deaminase
MPHSDEHWMRQALARARQGAATGEVPVGAVIVLNDTVIGEGWNQPITSADPTAHAEIVALRSAAQQQHNYRLPDATIYVTIEPCTMCAGALIHSRIKRLVFGTPEPRAGAVCSHFRLLDTEGIYNHRVAWEQGVLAEDCAQLISSFFQARRKPVE

SEQ ID NO: 1095 - protein, 162 aa, unidentified
  source 1..162: note = MG137-14 Deaminase
MSPASSAIEEQEQHESWMRLALEQAQLAAAADEVPVGAVLVRDRVLVAAGHNQPIGACDPTAHAEIVTLRKAAQAAENYRLPGSVLYVTIEPCTLCLGAIIHARVDTLVFAAREPRAGAVVSRQRLGEQQYFNHQPAVIEGVLAIDSAALMQAFFAGRRSGQ

SEQ ID NO: 1096 - protein, 155 aa, unidentified
  source 1..155: note = MG137-15 Deaminase
MQQHSTDQHWMRLALELADRAAAEGEVPVGAVLVRAGELLGSGYNRVIGACDPSAHAEINALRAAALAESNYRLAGATLYVTLEPCTMCVGALVHARVARLVFAAREPKAGMVCSNAALLDQPHYNHRVQWQEGVLAAESAARLQAFFRARRQSG

SEQ ID NO: 1097 - protein, 153 aa, unidentified
  source 1..153: note = MG137-16 Deaminase
MDTTSHAHWMALALERAREAARQDEVPVGALLVRGGEALGEGSNRPVSSHDPTAHAEIIALREAARREGNYRLPGSVLYVTIEPCTMCVGAIIHARIDLLVFGAREPRYGAVVSARRLLDSDRYNHHPAVLEGVLADECGDLMRGFFRARRNR

SEQ ID NO: 1098 - protein, 167 aa, unidentified
  source 1..167: note = MG137-17 Deaminase
MPDISDDRHWMSRALQLAQQAAAAGEVPVGAIVVLDGQEVGAGFNAPISACDPTAHAEIRALRDAAARVGNYRLSGATLYVTLEPCTMCVGAIVHGRISRLVYGATEPKAGAVESARRTLDEPHLNWAVEATGGVLEQQCSEIISEFFSRRRAEIRRQRQSSSPGKE

SEQ ID NO: 1099 - RNA, 269 nt, synthetic construct
  source 1..269: mol_type = other RNA; note = MG35-1 active effectors sgRNA
nnnnnnnnnnnnnnnnnnnngtaactgtccataaataacttagtcaactaagttattttaaagttacccgcctaagttcttcgagaactacgttagggatgaaaacataggtactctcgcgatgcttctccagtccgagactctacggggaactattaaacaggtccgatggaaaggccagtgtagtttccattcaaaaccgtcctataacattggctaggagactattacccgcgtcagcggagctaggtaacaatttatgcaaagag

SEQ ID NO: 1100 - RNA, 233 nt, synthetic construct
  source 1..233: mol_type = other RNA; note = MG35-2 active effectors sgRNA
nnnnnnnnnnnnnnnnnnnnggctattgaagatttgaagtgggaaacccgcaaaaagtctaatagccacagccacagcgacgtatgtaagttttctctcaggtagaggcgacggatgcacctgcgggttttcccagctcgcagcaactgccaagcatacgccaaggcaagggaaacactaccaccccattggggtgtgccttaacggaaaaaactatgaaaggagataacgtt

SEQ ID NO: 1101 - RNA, 277 nt, synthetic construct
  source 1..277: mol_type = other RNA; note = MG35-3 active effectors sgRNA
nnnnnnnnnnnnnnnnnnnngtcaggaacctcggccttaaggcacgaggcttgcaggagaaatccggtaagccattctgaccagcctcagtcttaactggctacatttcgagagtcacgacacccttagatgcgtgctagtcttccgctctgtcgttaacaattaaacagttctaaggtcactggaacggtgttgttaacctaacaagctctcgaaatattggcgaagcaaacattaccccgcaagggaggatttcatgcaaaattacacatttgta

SEQ ID NO: 1102 - RNA, 276 nt, synthetic construct
  source 1..276: mol_type = other RNA; note = MG35-4 active effectors sgRNA
nnnnnnnnnnnnnnnnnnnngtaaactacccgacactaagctgagtacagctataatgggggcttttaaagaagcctagagtttacccgactaagtacctcgcgtactacgttttggaagccatcacacctacggatacgaagccagtctgtagctctgtggttaacgattaaacaggtatatcgggtcgaaaccagtgtcgttagcgcgacaaacttctaaaacattgtcaaggctaccattacccgtaaggagactcactcgtgagtaaagttt

SEQ ID NO: 1103 - RNA, 286 nt, synthetic construct
  source 1..286: mol_type = other RNA; note = MG35-5 active effectors sgRNA
nnnnnnnnnnnnnnnnnnnngtcaacgacccaacactaattaaaatatagtgtgggcttgtaatcagtattgcaagtcttgagttgaccagactaagtgaagaactacgttattactaagagttaaagacctacctacggatgcttgcaagtctgtagcactagaactgaacagttaaatattctatttgggtattgaaagtgctgttcggatagttaccgggtaataacattgtcgatgcaaacattactgaataaaggagggacgcaacaatgtccaaaaccaa

SEQ ID NO: 1104 - RNA, 276 nt, synthetic construct
  source 1..276: mol_type = other RNA; note = MG35-6 active effectors sgRNA
nnnnnnnnnnnnnnnnnnnngtaaactacccgtcaccaagctgagtacagctatggtgggggctttttaaaaagcctagagtttacccgactaagtacctcgtgtactacgttttggaagccatcacacctacagatacgaagccagtctgtagcactgtggttaacgattaaacaggcatatcgggttgaagccagtgtcgttagcgcgacaaacttctaaaacattgtcaaggctaccattacccgcaaggagactcacaagttgagtaaagtt

SEQ ID NO: 1105 - RNA, 291 nt, synthetic construct
  source 1..291: mol_type = other RNA; note = MG35-102 active effectors sgRNA
nnnnnnnnnnnnnnnnnnnngtcatgaaccccatgcctaaaggcaggggcttgtagactgcccgactcttcgagcgggatacaagccagaacatgaccagcctaaaaccttcgaggtctacgtttttaaggtcaagatacctacaaatgcgtcgctagtttgtagccctatcgttggttgttaaacatctgtaatgggttaaggaagtgcagtcaacatgacaagccttgaaaacattggcgaagcgaacattacgagcaatcagaggagacgcaacaatgtctaactttg

SEQ ID NO: 1106-1111 - skipped (6 entries)

SEQ ID NO: 1112 - DNA, 1869 bp, synthetic construct
  source 1..1869: mol_type = other DNA; note = ABE-MG35-1 active adenine base editor gene
atgcagcgcgttttcgtgctggaccacaacaagcagccactgatgccctgtcatccagcgcgcgcccgtaagttacttaagaaaggcaaagccgcggtgtatcgtcgttatccgtttgccatcatcatgactcatcgtgtcggcggagacctgcagactgttgagatcaagttcgccccgggcagtcgtaccacaggtattgcgctggtcggcgacttcgatcgcggtaaagaggtgatttgggccgggaatctgaatcaccgcggccaccaaattaagtcgaacctgaattcccgccgcgcgattcgtcgtgctcgtcgcaaccgcaaaacccgctaccgccaagctcgcttcaacaatcgtcgccgtccgaagggatggttaccgccgtctctgcgtagccgtgtagacaacacgaagaactggatgcacaaattggcgcgtctggcgccgcttacccagattgccgtggagaccgtgcgcttcgacacccaaaagctccagaagcctgagatctcaggcgtcgagtaccagcagggcgaactggctggatacgaattgcgcgagtatctcctggagaagtggggacgcgagtgcgcatactgcggcgctaagaacatccctctggagatcgagcatattcaggcccgcagtaagggcggctcagaccgtgtgagtaatctgacgctggcctgtacaccgtgcaacattgacaaaggaaacaaagacatcaaggaattcctgagcctgaaaccaaagcgcctgaagaagattcaggcaaccgccaccgccccgctgaaggacgccgccgcggttaacgcgacacgttatgcaaccggtaacgtactgaagtgctttagcttgccaatcacgtttagctcgggcggccgtacgaagttcaatcgcgttaaacttggttatctgaaggatcactggatcgatgccgcgtgcgttggagagtctggcagccaggtggtcatcccaaaggcaattaccccgctgatcattaccagcaaaggccgcggctctcgccaaaagtgccgcatgaaccagtatggattcccccgcacgggtccaaagaagcagaaacaagtgaaaggattccagacaggtgacatcgttaaggcgattgttaccaagggcaagaaaattggtacctacatcggccgcgtcgtagttcgttcacgcgggagtttcgacatcgggtctggagagaagaaggtcggatcaatcagctacaagtactgtcagctgttgcagcgcgccgacggatatgaatatacgtcggggagtgaaacacccggcacatccgaagcttcgacacctgaatctgcctccgaggttgaatttagtcatgaatattggatgcgccacgcgctgacgttagccaaacgtgctcgtgatgagcgcgaagttccagtcggggccgtcttggtccttaacaatcgtgtcattggcgaggggtggaaccgcgctattgggctgcacgatccaacagcgcatgctgagattatggccttgcgtcaaggagggttagtaatgcaaaactaccgtcttattgatgctacgttatactctacattcgaaccctgtgtaatgtgtgcaggagcgatgatccacagtcgtattggccgcgtagtatttggtgtacgcaatgctaaaactggagccgccggatcgttgatggatgtcttgcattaccctggaatgaaccatcgtgtagagatcactgaaggcatccttgccgatgagtgtgcggctttgctttgctatttcttccgtatgccacgtcgtgtttttaacgcccaaaaaaaggctcaatccagtaccgatgggtcaggcctttctcccaagaagaagaggaaagtc

SEQ ID NO: 1113 - protein, 623 aa, synthetic construct
  source 1..623: note = ABE-MG35-1 active adenine base editor
MQRVFVLDHNKQPLMPCHPARARKLLKKGKAAVYRRYPFAIIMTHRVGGDLQTVEIKFAPGSRTTGIALVGDFDRGKEVIWAGNLNHRGHQIKSNLNSRRAIRRARRNRKTRYRQARFNNRRRPKGWLPPSLRSRVDNTKNWMHKLARLAPLTQIAVETVRFDTQKLQKPEISGVEYQQGELAGYELREYLLEKWGRECAYCGAKNIPLEIEHIQARSKGGSDRVSNLTLACTPCNIDKGNKDIKEFLSLKPKRLKKIQATATAPLKDAAAVNATRYATGNVLKCFSLPITFSSGGRTKFNRVKLGYLKDHWIDAACVGESGSQVVIPKAITPLIITSKGRGSRQKCRMNQYGFPRTGPKKQKQVKGFQTGDIVKAIVTKGKKIGTYIGRVVVRSRGSFDIGSGEKKVGSISYKYCQLLQRADGYEYTSGSETPGTSEASTPESASEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDGSGLSPKKKRKV

SEQ ID NO: 1114 - DNA, 9265 bp, synthetic construct
  source 1..9265: mol_type = other DNA; note = pMG3078
gccgccaccatgggtaaaagaacagccgacgggtctgaattcgaacccaagaaaaagaggaaggtcggtaccgaagcctctccagcaagcagaccccgaccactcatgggccctcgcacgttcactgaaaacttcactaataatccggaagtgtttggtagacatcagacatacctttgctacgaagtgaaatgccaggggccagatggaactagagatttgatgacagaacagcgggactttctctgcaaccaagctaggaacctcttgagcggcttcgacgggcgccatgctgagcggtgttttctcgatagggttccgagttggagactggacccggcccagacgtatagggtcacctgtttcatctcctggtcaccttgcttctcctgtgctcgcgaagtggcagaatttcttcaggaaaacccacacgtgaatttgagaatctttgccgcccggatctatgattgccgacctcggtatgaagaaggattgcaaatgctgcaaaatgctggtgcccaggtgtccatcatgacctctgaggagttccgccactgttgggacacctttgtggaccatcagggacacccgttccagccctgggaaggcctcgatgagcattcccaggccctgtccagaagattgcaggccattcttcaaggtaatcggtggatgatcctgagcctgggcactagttctggcggatctagcggagggtcctctggctctgagacaccaggaacaagcgagtcagcaacaccagagagttcaggcggcagcagtggcggcagcgctagcgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgaccctaggcccggggagctctatccatacgatgtccccgactacgcatatccctatgatgtacctgattatgcgtatccttatgacgtgccagactacgcggatatcaaaagaaccgccgacggcagcgagttcgagcccaagaagaagaggaaagtctgaggatccgcaggcctctcctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagctt

SEQ ID NO: 1115 - DNA, 4669 bp, synthetic construct
  source 1..4669: mol_type = other DNA; note = pMG3072
gccgccaccatgggatctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaggatccgcaggcctctgctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagctt

SEQ ID NO: 1116 - DNA, 20 bp, synthetic construct
  source 1..20: mol_type = other DNA; note = PE266
ggcccagactgagcacgtga

SEQ ID NO: 1117 - DNA, 20 bp, synthetic construct
  source 1..20: mol_type = other DNA; note = PE691
ttgccacgaagcaggccaat

SEQ ID NO: 1118 - DNA, 150 bp, synthetic construct
  source 1..150: mol_type = other DNA; note = PE266 NGS Amplicon
gcatgcatttgtaggcttgatgctttttttctgcttctccagccctggcctgggtcaatccttggggcccagactgagcacgtgatggcagaggaaaggaagccctgcttcctccagagggcgtcgcaggacagcttttcctagacaggg

SEQ ID NO: 1119 - DNA, 150 bp, synthetic construct
  source 1..150: mol_type = other DNA; note = PE691 NGS Amplicon
ggaggaggaagggcctgagtccgagcagaagaagaagggctcccatcacatcaaccggtggcgcattgccacgaagcaggccaatggggaggacatcgatgtcacctccaatgactagggtgggcaaccacaaacccacgagggcagagt

SEQ ID NO: 1120 - protein, 428 aa, unidentified
  source 1..428: note = MG35-1 active effector amino acid sequence
MQRVFVLDHNKQPLMPCHPARARKLLKKGKAAVYRRYPFAIIMTHRVGGDLQTVEIKFDPGSRTTGIALVGDFDRGKEVIWAGNLNHRGHQIKSNLNSRRAIRRARRNRKTRYRQARFNNRRRPKGWLPPSLRSRVDNTKNWMHKLARLAPLTQIAVETVRFDTQKLQKPEISGVEYQQGELAGYELREYLLEKWGRECAYCGAKNIPLEIEHIQARSKGGSDRVSNLTLACTPCNIDKGNKDIKEFLSLKPKRLKKIQATATAPLKDAAAVNATRYATGNVLKCFSLPITFSSGGRTKFNRVKLGYLKDHWIDAACVGESGSQVVIPKAITPLIITSKGRGSRQKCRMNQYGFPRTGPKKQKQVKGFQTGDIVKAIVTKGKKIGTYIGRVVVRSRGSFDIGSGEKKVGSISYKYCQLLQRADGYEYT

SEQ ID NO: 1121 - protein, 150 aa, unidentified
  source 1..150: note = Fam72A peptide sequence
MGSTNICSFKDRCVSILCCKFCKQVLSSRGMKAVLLADTEIDLFSTDIPPTNAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 1122 - protein, 494 aa, unidentified
  source 1..494: note = MG35-2 active effector amino acid sequence
MDMVYVLNKDGKPLMATTRGGRVRYLLKEKKARVVSSTPFTIQLNYDTPDATQDLILGIDPGRTNIGVAVVKEDGQCVFSAHLETRNKEVPLLMKKRAAFRRQHRTQDRRRKRQRRAIAAGTTVESNTIERLLPGYEKPIVCHHIRNKEARFNNRSRPAGWLTPTANHLLQAHINLIAKAAKFLPITKVVVELNRFAFMAMDNPNIRRWEYQQGPLYGLGSVKDAVYAQQDGHCLFCKKPIDHYHHVVPRHKGGSETLANRCGLCEKHHALVHKDKAWAEKLVTRKGGMNKKYHALSVLNQIIPHLMEYIGSETLYDAYATDGRSTKGFRIAKNVPKEHYTDAYCIACSILDADTKVSTPVEPFELKQFRRHDRQACIRQMVDRKYLLHGKVVAANRHKAIEQKSDSLEEFREAHGNAAVSQLTVKPHHSQCKDMARIMPGAMMDFDGIVGVFKGSSGRNNGTPNYYNSTKGERFLTRSCVLLAQNAGMVFIPA

SEQ ID NO: 1123 - protein, 423 aa, unidentified
  source 1..423: note = MG35-3 active effector amino acid sequence
MQNYTFVLDTNKQPLFPVHPAVARKMLSNAEAAVFRRYPFTIILKHGADRPTQSIEIKLDPGSKTTGIALLKGERLIFAAELSHRGQAIKASLDARRAIRRNRRTRHTRYRPARFLNRTRSKGWLTPSLKHRVCTTLTWVNKFIRFAPVNSIAMELVRFDLQQLENPEISGVEYQQGELLGYEIREYLLNKWDRKCTYCGAENIPLQVEHIHPRAKGGSNRISNLCLACEKCNLKKGTQDIKDFLSKKTDLLKQIMAQAKRPLKDASAVNSTRWALFNQLKLTGLPVTTGSGGQTKYNRTRLELPKTHYFDAACVGKVDKLVVLTTQPLLIKANGHGTRQMCRTDKFGFPSRHAPRNKFVKGFQTGDIVKAIVTSGKKIGEYVGRAAVRSSGSFNISAKELVQGIGHKYCEILHRKDGYSYQF

SEQ ID NO: 1124 - protein, 428 aa, unidentified
  source 1..428: note = MG35-4 active effector amino acid sequence
VSKVFVLDTNKQPLNPIHSGRARMLLSQGKAAVFRGFPFTLILKEEVSSPDVKPLRIKIDPGAKTTGLALVNDKTGEVVWVAELQHRDFQIRDALTSRRQLRRFRRSRKTRYRKPRFLNRTRPKGWLPPSLNSRVANILTWVKRLSSLCQINAISQELVRFDTQQMENPEISGTGYQQGTLAGYEIREFLLEKWNRTCAYCGAKDTKLEIEHIQPRSKGGSNRVSNLCLACVPCNREKGNQDIKDFLKGKPDLLKRILGQAKRPLADTSAVNATRWNLYDNLRQTSLPVEVGTGGLTKYNRTIRGLDKTHYWDAACVGASTPERLITSGIKPLLISAKGHGTRQQCRTNKLGFPVRYCSRTKFHKGFQTGDIVKAVVTSGKKVGTYVGRVATRATLRFNISTKDGLVQGISHKYCKHIHKKDGYAYAY

SEQ ID NO: 1125 - protein, 493 aa, unidentified
  source 1..493: note = MG35-5 active effector amino acid sequence
MSKTNYVLVVDTNKHPLSPCKPGVARSLLKAGKAAVFRRYTFTIILKKEVEGDILKSQIKIDPGSKTTGLALVQNGVVIWAAELQHRGQLIKQSLDNRRSLRRNRRNRKTRYRQPRFLNRVKSKPKGWLAPSLMHRVENVSTWVNKLIKFSAVDSVMMELVRFDTQKMTNPDVSGVQYQQGELTGYEVREYLLEKFDRTCVYCQAKNVPLEVEHIQPKSKGGSNRISNLTLACRPCNQSKGNQDIQDFLSGKPSLLKRILNQTKQPLKDAAAVNSTRWKLKESLELTGLPVFTGNGALTKYNRCRLGLPKTHWLDAASVGEIDNLVIATHQPLLIKSFGFGSRQMCRTDKYGFPTRHCSRQKVHFGFTTGDIVKADIPKGKYAGKYTARVTVRSTGSFAIKSLTHGKQIDVNHKYCKAIHKLDGYGYGFGELININPTKLNPVETQIVKGRTAANPTQLNLFDSSIFAVESSESKIHKKQKVKGDDYEQLSLF

SEQ ID NO: 1126 - protein, 428 aa, unidentified
  source 1..428: note = MG35-6 active effector amino acid sequence
MSKVFVLDTNKQPLNPIHPGRARMLLSQRKAAVFRRYPLTLILKEEVLNPDIEPLRIKIDPGAKTTGLALVNDSTGEVVWIAELQHRGFQIRDALTSRRQLRKSRRSRKTRYRKPRGLNRTRPTGWLPPSLNSRVANILTWVKRLSSLCQINAISQELVRFDTQQMENPEISGIAYQQGTLAGYEVREFLLFKWDRTCAYCGAKDTKLEVEHIQSRSKGGSNRVSNLCLACVPCNREKGNQDIKDFLKGKPDLRKQILAQAKRPLADAAAVNVTRWNLYFNLKKMGLPVEIGTGGRTKYNRTKLLLEKTHYWDAACVGESTPERLITAGIKPLLINAKGHGTRQQCRPNKFGFPVRYCSRTKFHKGFQTGDIVKAVVTSGKKVGTHQGRVATRATGRFNISTTDGLVQGISHKYCKHIHKKDGYAYVA

SEQ ID NO: 1127 - protein, 424 aa, unidentified
  source 1..424: note = MG35-102 active effector amino acid sequence
MSNFVFVIDTNHKPLSPCKPGMARSLLKAGKAAVFRRYPFTIILKKAVETNPEPLELKLDPGSKVTGIAIKQGDKIIFGAELQHRGQQIKEALLSCRQLRRGRRNRKTRYRQARFLNRTRPDGWLAPSLQHRIETALTWVRKLIRFAPIARIVQELVRFDTQLIQNPEISGVLYQQGELQGYEVREYLLEKWNRQCAYCSAQNVPFEVEHIQPKSKGGSDRVPNLTLACHDCNQKKGNQDVRAFLATKPDLLNRILKQAKLPLKDAAAVNSTRWALFNALKETGLPVTTGTGGQTKFNRNRLGLPKSHWLDAACVGNFEALEVLTSKPLLIAAKGHGTRQMCGTNKYGFPTRHKSRVQIHKGYQTGDIVSATVTAGKKVGSYIGRVLCRASGSFDIATKTGRITGISHKYCNPIHKKDGYSYAF

SEQ ID NO: 1128 - protein, 1369 aa, unidentified
  source 1..1369: note = 3-68_DIV1_M_RDr1v1_B
MAPKKKRKVGGGGSMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSGTSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1129 - protein, 1381 aa, synthetic construct
  source 1..1381: note = 3-68_DIV2_M_RDr1v1_B
MAPKKKRKVGGGGSMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTKGKGKGMGAGTLSTDKGESLGIKYEEGQSHRPTNPNASRMAQKVGTSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1130 - protein, 1395 aa, unidentified
  source 1..1395: note = 3-68_DIV3_M_RDr1v1_B
MAPKKKRKVGGGGSMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTCYGKKYGPKGKGKGMGAGTLSTDKGESLGIKYEEGQSHRPTNPNASRMAQKVGGSDGCGTSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1131 - protein, 1353 aa, unidentified
  source 1..1353: note = 3-68_DIV4_M_RDr1v1_B
MAPKKKRKVGGGGSMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGSETPGTSESATPESGTSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1132 - protein, 1369 aa, unidentified
  source 1..1369: note = 3-68_DIV5_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGGTSGGSSGGSSGSETPGTSESATPESSGGSSGGSGTMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGKRPAATKKAGQAKKKK

SEQ ID NO: 1133 - protein, 1381 aa, unidentified
  source 1..1381: note = 3-68_DIV6_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGGTKGKGKGMGAGTLSTDKGESLGIKYEEGQSHRPTNPNASRMAQKVGTMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGKRPAATKKAGQAKKKK

SEQ ID NO: 1134 - protein, 1395 aa, unidentified
  source 1..1395: note = 3-68_DIV7_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGGTCYGKKYGPKGKGKGMGAGTLSTDKGESLGIKYEEGQSHRPTNPNASRMAQKVGGSDGCGTMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGKRPAATKKAGQAKKKK

SEQ ID NO: 1135 - protein, 1353 aa, unidentified
  source 1..1353: note = 3-68_DIV8_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGGTSGSETPGTSESATPESGTMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGKRPAATKKAGQAKKKK

SEQ ID NO: 1136 - protein, 1369 aa, unidentified
  source 1..1369: note = 3-68_DIV9_M_RDr1v1_B
MAPKKKRKVGGGGSSTDMKNYRIGVAVGDRSVGLAAIEFGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1137 - protein, 1369 aa, unidentified
  source 1..1369: note = 3-68_DIV10_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1138 - protein, 1369 aa, unidentified
  source 1..1369: note = 3-68_DIV11_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1139 - protein, 1369 aa, unidentified
  source 1..1369: note = 3-68_DIV12_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1140 - protein, 1369 aa, unidentified
  source 1..1369: note = 3-68_DIV13_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1141 - protein, 1369 aa, unidentified
  source 1..1369: note = 3-68_DIV14_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1142 - protein, 1369 aa, unidentified
  source 1..1369: note = 3-68_DIV15_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1143 - protein, 1369 aa, unidentified
  source 1..1369: note = 3-68_DIV16_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1144 - protein, 1369 aa, unidentified
  source 1..1369: note = 3-68_DIV17_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1145 - protein, 1369 aa, unidentified
  source 1..1369: note = 3-68_DIV18_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1146 - protein, 1369 aa, unidentified
  source 1..1369: note = 3-68_DIV19_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKREGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTLFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1147 - protein, 1369 aa, unidentified
  source 1..1369: note = 3-68_DIV20_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1148 - protein, 1369 aa, unidentified
  source 1..1369: note = 3-68_DIV21_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1149 - protein, 1369 aa, unidentified
  source 1..1369: note = 3-68_DIV22_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1150 - protein, 1369 aa, unidentified
  source 1..1369: note = 3-68_DIV23_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1151 - protein, 1369 aa, unidentified
  source 1..1369: note = 3-68_DIV24_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1152 - protein, 1369 aa, unidentified
  source 1..1369: note = 3-68_DIV25_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1153 - protein, 1369 aa, unidentified
  source 1..1369: note = 3-68_DIV26_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1154 - protein, 1369 aa, unidentified
  source 1..1369: note = 3-68_DIV27_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1155 - protein, 1369 aa, unidentified
  source 1..1369: note = 3-68_DIV28_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1156 - protein, 1369 aa, unidentified
  source 1..1369: note = 3-68_DIV29_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1157 - protein, 1369 aa, unidentified
  source 1..1369: note = 3-68_DIV30_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1158 - protein, 1369 aa, unidentified
  source 1..1369: note = 3-68_DIV31_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1159 - protein, 1369 aa, unidentified
  source 1..1369: note = 3-68_DIV32_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1160 - protein, 1369 aa, unidentified
  source 1..1369: note = 3-68_DIV33_M_RDr1v1_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1161 - protein, 972 aa, unidentified
  source 1..972: note = MG68-4
MTDSQNDTDEYWMGEALKLAQKARDEGEVPVGAILVRKGEVIGHGWNRSIGSHDPSAHAEIMAIREAGVRIGNYRMLDTVLYVTLEPCAMCAGALVHGRISRLVFGAEDPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1162 - protein, 972 aa, unidentified
  source 1..972: note = MGA1.1RD1
MTDSQNDTDEYWMGEALKLAQKARDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1163 - protein, 972 aa, unidentified
  source 1..972: note = MGA1.1RD2
MTDSQNDTDEYWMGEALKLAQKAWDEGEVPVGAILVLKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1164 - protein, 972 aa, unidentified
  source 1..972: note = MGA1.1RD3
MTDSQNDTDEYWMGEALKLAQKAWDEGEVPVGAILVRKGEVIGHGWNRAIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1165 - protein, 972 aa, unidentified
  source 1..972: note = MGA1.1RD4
MTDSQNDTDEYWMGEALKLAQKAWDEGEVPVGAILVRKGEVIGHGWNRSIGLHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1166 - protein, 972 aa, unidentified
  source 1..972: note = MGA1.1RD5
MTDSQNDTDEYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1167 - protein, 972 aa, unidentified
  source 1..972: note = MGA1.1RD6
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1168 - protein, 972 aa, unidentified; identical to SEQ ID NO: 840
  source 1..972: note = MGA1.1RD7

SEQ ID NO: 1169 - protein, 972 aa, unidentified
  source 1..972: note = MGA1.1RD8
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENSKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1170 - protein, 972 aa, unidentified
  source 1..972: note = MGA1.1RD9
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKRGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1171 - protein, 972 aa, unidentified
  source 1..972: note = MGA1.1RD10
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMNIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1172 - protein, 972 aa, unidentified
  source 1..972: note = MGA1.1RD11
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIANHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1173 - protein, 972 aa, unidentified; identical to SEQ ID NO: 851
  source 1..972: note = MGA1.1RD12

SEQ ID NO: 1174 - protein, 972 aa, unidentified
  source 1..972: note = MGA1.1RD13
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLCDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1175 - protein, 972 aa, unidentified
  source 1..972: note = MGA1.1RD14
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSYFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1176 - protein, 972 aa, unidentified
  source 1..972: note = MGA1.1RD15
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSRFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1177 - protein, 972 aa, unidentified
  source 1..972: note = MGA1.1RD16
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFYRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1178 - protein, 972 aa, unidentified
  source 1..972: note = MGA1.1RD17
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWPRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1179 - protein, 972 aa, unidentified
  source 1..972: note = MGA1.1RD18
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRRQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1180 - protein, 972 aa, unidentified
  source 1..972: note = MGA1.1RD19
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAVKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1181 - protein, 972 aa, unidentified
  source 1..972: note = MGA1.1RD20
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQFKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1182 - protein, 972 aa, unidentified
  source 1..972: note = MGA1.1RD21
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKNAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1183 - protein, 972 aa, unidentified
  source 1..972: note = MGA1.1RD22
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSINGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1184 - protein, 991 aa, unidentified
  source 1..991: note = MAG0.1_2NLS
MKRTADGSEFESPKKKRKVMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAEDPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1185 - protein, 991 aa, unidentified
  source 1..991: note = MAG1.1_2NLS
MKRTADGSEFESPKKKRKVMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1186 - protein, 991 aa, unidentified
  source 1..991: note = MAG2.1_2NLS
MKRTADGSEFESPKKKRKVMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNNQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1187 - RNA, 124 nt, synthetic construct
  source 1..124: mol_type = other RNA; note = guide 2 for ABE using MG34-1
tgttacagttaagaaattaattgtaaaacgcctatacagtgaagggatatacgcttgggtttgtccagcctgagcctctatgccagaaatggcgccttcatcgtgggttaggacatttaatttt

SEQ ID NO: 1188 - RNA, 89 nt, synthetic construct
  source 1..89: mol_type = other RNA; note = sgRNA68
agttgagaatcgaaagattcttaataaggcatccttccgatgctgacttctcaccgtccgttttccaataggagcgggcggtatgtttt

SEQ ID NO: 1189 - RNA, 89 nt, synthetic construct; identical to SEQ ID NO: 1188
  source 1..89: mol_type = other RNA; note = sgRNA46

SEQ ID NO: 1190 - RNA, 89 nt, synthetic construct; identical to SEQ ID NO: 1188
  source 1..89: mol_type = other RNA; note = sgRNA49

SEQ ID NO: 1191 - RNA, 89 nt, synthetic construct; identical to SEQ ID NO: 1188
  source 1..89: mol_type = other RNA; note = sgRNA51

SEQ ID NO: 1192 - RNA, 89 nt, synthetic construct; identical to SEQ ID NO: 1188
  source 1..89: mol_type = other RNA; note = sgRNA53

SEQ ID NO: 1193 - RNA, 89 nt, synthetic construct; identical to SEQ ID NO: 1188
  source 1..89: mol_type = other RNA; note = sgRNA54

SEQ ID NO: 1194 - RNA, 89 nt, synthetic construct; identical to SEQ ID NO: 1188
  source 1..89: mol_type = other RNA; note = sgRNA55

SEQ ID NO: 1195 - RNA, 89 nt, synthetic construct; identical to SEQ ID NO: 1188
  source 1..89: mol_type = other RNA; note = sgRNA62

SEQ ID NO: 1196 - RNA, 19 nt, synthetic construct
  source 1..19: mol_type = other RNA; note = guide 2 for ABE using MG34-1
gggaaagacccagcatccg

SEQ ID NO: 1197 - RNA, 21 nt, synthetic construct
  source 1..21: mol_type = other RNA; note = sgRNA68
acagacaaaactgtgctagac

SEQ ID NO: 1198 - RNA, 22 nt, synthetic construct
  source 1..22: mol_type = other RNA; note = sgRNA46
cgaatcctcctcctgaaagtgg

SEQ ID NO: 1199 - RNA, 22 nt, synthetic construct
  source 1..22: mol_type = other RNA; note = sgRNA49
taaacccggccactttcaggag

SEQ ID NO: 1200 - RNA, 22 nt, synthetic construct
  source 1..22: mol_type = other RNA; note = sgRNA51
atcactgacaggttttgaaagt

SEQ ID NO: 1201 - RNA, 22 nt, synthetic construct
  source 1..22: mol_type = other RNA; note = sgRNA53
tcactgacaggttttgaaagtt

SEQ ID NO: 1202 - RNA, 22 nt, synthetic construct
  source 1..22: mol_type = other RNA; note = sgRNA54
gaatcctcctcctgaaagtggc

SEQ ID NO: 1203 - RNA, 22 nt, synthetic construct
  source 1..22: mol_type = other RNA; note = sgRNA55
ttaaacccggccactttcagga

SEQ ID NO: 1204 - RNA, 22 nt, synthetic construct
  source 1..22: mol_type = other RNA; note = sgRNA62
agacagacttgtcactggattt

SEQ ID NO: 1205 - DNA, 7459 bp, synthetic construct
  source 1..7459: mol_type = other DNA; note = Expression of MG3-6_3-8 adenine base editor
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcgatggcccccaagaagaagagaaaagtcggcggaggcggcagcagcaccgacatgaagaactacagaatcggcgtggccgtgggcgacagaagcgttggactggctgccatcgagttcgacgatgacggactgcccatccagaagctggccctggtcacattcagacacgacggtggactggaccccaccaagaacaagacccctatgagcagaaaagagacacggggaatcgccagacggaccatgagaatgaacagagagcgcaagagaaggctgaggaacctggacaacgtgctggaaaacctgggctactctgtgcctgagggccctgagcctgagacatacgaggcctggacatctagagccctgctggcctctatcaaactggcctctgccgacgagctgaacgaacaccttgtcagagccgtgcggcacatggccagacatagaggatgggccaatccttggtggtccctggaccagctggaaaaggccagccaagagcctagcgagacattcgagatcatcctggccagagccagagagctgttcggcgagaaggtgcccgctaatcctacactgggaatgctgggagccctggccgctaacaatgaggtgctgctgaggcccagggacgagaagaagagaaagaccggatacgtgcggggcacccctctgatgtttgctcaagttcgacagggcgatcagctggccgagctgcggagaatttgtgaagtgcagggcatcgaggaccagtacgaggctctgagactgggcgtgttcgaccacaagcacccctacgtgcccaaagaaagagtgggcaaagaccctctgaaccccagcaccaacagaaccatcagagccagcctggaatttcaagagttccgcatcctggacagcgtggccaatctgagagtgcggatcggcagcagagccaagagggaactgacagaggccgagtatgatgccgccgtggaattcctgatggactacgccgacaaagagcagcctagctgggccgatgtggccgagaaaattggcgtgcccggcaacagactggtggcccctgttctggaagatgtgcagcagaaaacagccccttacgacagaagcagcgccgcctttgagaaggccatgggcaagaaaaccgaggccagacagtggtgggagtccaccgatgatgaccagctgagaagcctgctgattgccttcctggtggacgccaccaacgacacagaagaagccgctgctgaagccggcctgagcgagctgtataagtcttggcctgccgaggaaagagaggccctgtccaacatcgacttcgagaagggcagagtggcctacagccaagaaaccctgagcaagctgagcgagtacatgcacgagtacagagtgggactgcacgaggctagaaaggccgtgttcggagtggatgatacctggcggcctcctctggataagctggaagaacctacaggacagcctgccgtggacagagtgctgaccatcctgagaagattcgtgctggactgcgagcggcaatggggcagacctagagccatcaccgtggaacacacacggacaggcctgatgggcccaacacagagacagaagatcctgaacgagcagaagaagaaccgggccgacaacgagagaatccgggatgagctgagagaatctggcgtggacaacccctccagagccgaagttcggagacacctgatcgtgcaagagcaagagtgccagtgcctgtactgcggcaccatgatcaccaccaccacaagcgagctggaccacatcgttcctagagccggtggcggcagcagcagaagggaaaatctggccgctgtgtgcagagcctgcaacgccaagaagaaacgcgagctgttctacgcctgggctggcccagtgaagtcccaagagacaatcgagagagtcagacagctgaaggcctttaaggacagcaagaaagccaagatgttcaagaaccagatccgccggctgaaccagaccgaggccgatgagcctatcgacgaaagaagcctggccagcacatcttacgccgctgtggccgttagagagcggctggaacagcacttcaacgaaggcctggcactggacgacaagtccagagtggtgctggatgtgtatgccggcgctgtgaccagagagtctcgtagagctggcggcatcgacgagcggattctgctgagaggcgagcgggacaagaacagattcgatgtgcggcatcacgccgtggacgctgctgttatgaccctgctgaacagatccgtggctctgaccctggaacagagatcacagctgaggcgggccttctacgagcaaggactggacaaactggacagggatcagctgaagcccgaagaggactggcggaacttcatcggactgggtacctcggggagtgaaacacccggcacatccgaaagtgcgacacctgaatctatgaccgactctcaaaatgacactgatgaatactggatgggtgaggctcttaaactggcgcagaaagcctgggacgaaggtgaagtgcctgttggcgccatcctggtccggaaaggggaagtgattgggcacgggtggaatcgaagcattgggtcacacgatccatccgctcatgcagaaattatggcgatcagagaggccggagttcgaatcggaaattatagaatgcttgataccgtgctgtacgtgaccttagagccctgcgcaatgtgcgcaggtgccctggttcatggaagaattagccggctggtgtttggagcagagaaccccaagactggggcttgtggatctgttatggacattgcaaggcatccagccctgaaccatcaactccaagttgatggcggagtcatggctgccccctgcgcccgcttattgtccgacttcttccgctggcgccgtgcgcaaaagaaagctgccagagataactctagcggaaattcggggagtgaaacacccggcacatccgaaagtgcgacacctgaatctggtaccagcctggcctctcaagagaagttcctggaatggaagaaagtgaccaccgtgctgggcgacctgctggctgaagccatcgaggatgattctatcgccgtggtgtcccctctgaggctgaggccacaaaatggcagagtgcacaaggacacaatcgccgccgtgaagaagcagacactgggatctgcttggagcgccgacgccgtgaaaagaatcgtggaccccgagatctacctggctatgaaggatgccctgggcaagtccaaggtgctgccagaggatagcgcccggacactggaactgtccgatggcagatacctggaagccgacgacgaggtgctgttcttcccaaagaacgccgccagcatcctgacacctagaggcgtggcagagatcggcggctctattcaccatgccagactgtatagctggctgaccaagaagggcgagctgaagatcggcatgctgagagtgtacggcgccgagtttccctggctgatgagagagtctggatctcacgacgtgctgcggatgcctattcaccctggcagccagagcttccgggacatgcaggataccaccagaaaagccgtggaaagcagcgaggctgtggaattcgcctggatcacccagaacgatgagctggaattcgagcccgaggactacattgcccacggcggaaaggacgaactgcggcagtttctggaattcatgcctgagtgccgttggagagtggacggcttcaagaagaattaccagatcagaatcaggcccgccatgctgagcagagagcagctgcctagcgacatccagcggagactggaaagcaagaccctgaccgagaacgagtccctgctgctgaaagccctggatacaggactggtggtggccatcggaggactgctgcctctgggaaccctgaaagtgatccggcggaacaatctgggcttccccaggtggcgcggaaacggaaatctgcccaccagctttgaagtgcggagcagcgctctgagagccctgggagttgaaggatctggcggaaaaagacctgccgccacaaagaaagccggacaggccaagaaaaagaagtgaggatcccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgaagcttcatagttaagccagtatctgctcc

SEQ ID NO: 1206 - DNA, 2837 bp, synthetic construct
  source 1..2837: mol_type = other DNA; note = Expression of sgRNA for MG3-6_3-8 adenine base editor
ttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgaagcttgagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccacagacaaaactgtgctagacagttgagaatcgaaagattcttaataaggcatccttccgatgctgacttctcaccgtccgttttccaataggagcgggcggtatgtttttttcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgcatgctggggatgcggtgggctctatggc

SEQ ID NO: 1207 - DNA, 6653 bp, synthetic construct
  source 1..6653: mol_type = other DNA; note = Expression of MG34-1 adenine base editor
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcgatgaccgactctcaaaatgacactgatgaatactggatgggtgaggctcttaaactggcgcagaaagcctgggacgaaggtgaagtgcctgttggcgccatcctggtccggaaaggggaagtgattgggcacgggtggaatcgaagcattgggtcacacgatccatccgctcatgcagaaattatggcgatcagagaggccggagttcgaatcggaaattatagaatgcttgataccgtgctgtacgtgaccttagagccctgcgcaatgtgcgcaggtgccctggttcatggaagaattagccggctggtgtttggagcagagaaccccaagactggggcttgtggatctgttatggacattgcaaggcatccagccctgaaccatcaactccaagttgatggcggagtcatggctgccccctgcgcccgcttattgtccgacttcttccgctggcgccgtgcgcaaaagaaagctgccagagataactctagcggaaatggtacctcaggcgggtcttccggcggcagtagtgggagcgaaacaccgggcacaagtgagagcgcaacaccggaatcatctggcggttcaagcggcggatccatggaacgcgaattggtcttgggaattgcgtatggcggaaagtacactggtctggccgtcgtcgataggagacataaccaagtgctctacgcaaatagactgaagatgagggatgatgtcgccggcattcttaaagaccgccggaagcaaaggggcatcaggcgcaccgcccaaacaaagaagaagcgtttgcgagaacttaagaattatctcaaaagtataggttacaatgagtcaaccgctacttttgaaacggtttactcactggctcacaagaggggctatgactatgctgatatgcccgaggaaaagactagtgaagaaattgaagcaatggacgtggaagagcggaaacaatgggaaaaggagaaacaagagtgggaagagactaaacgaaactctagacatcgtaaagaagtcgtgaaggatgtccacaaagctatgattgaaggcagggctactgaggaacaaattaaaagagtggaacggatatttaataaacaatacagacccaagcgattcaataatcgcatcctgacaaaatgcaaggtcgaagactgcggagtcaacacccctttgaggaagaatgttagggatctcctgatagaaaatattgtgaggttcttcccaatagaacaatctgaaaaggataacttgaaggacgccgtgttggataagaatagaagggaagaagtcaagtccttctttaggaaacataaaaccgatgagcatatacgcaaacaggtgtatgatatagccgataacaagctctctggcaggacagtcttttgcaaggagcacattctggaacacacagaacattctaaggaagagaggaaagtattcagactcgctccgagtcttaagaccaaaatagagaatgtccttgccgtaattaaagatgaaatcctgcctaagttcaccgtcaataaagtcgtgatggagtctaacaatttcgacatcgctgccaaaactcaaggcaagaaacggctcgccaaagaagagtatggtaagggaccacgtgaaggcaaagaaaccaggaaagaagctctcctgcgggagactgatggcagatgcatatattgtgggaagtcaatagatatctccaatgctcatgacgaccatatctttcctcgaaaggccggcggactgaacatcttcgcaaatcttgtagcatgctgtgccgtgtgtaatgagaataagaaagggcggacacctctggaatcaggtattagcccaaagccagagatcatcgctttcatgaagaatgatctcaagaagaagatccttgaagacgcccgaaacataaacacggtggatttcaataagtacatgtcacatgccagcattggctggagatatatgagagaccgacttagggaatctgccgggaataagaagctcccgattgagaggcaaagcgggatctatacggcatactttcggagatggtggggattcaagaaggagcggggcaatacactccaccatgccttggatgctgttatcctggcgtcccggaaaggatatagcgatgacgggttggttgacatgacattgaaacctaaatacaacaaaggtggagagttcgatccagaaaagcacctgccagaacctattgagttcaaaatggacaaaggttccaggggatctgcacttcatgatagaaaccccttgtcctataagaagggaattattactcgtaggttcatggtcactgaaatcgagtgcgggaaagaggatgacgtgatctcagaaacttacagagagaaactcaaagaggcattcaagcgctttgataccaagaaaggaaaatgtctgaccgacaaggaagccaaagaggccggattctgcatcaagaagaatgagctggtgatgagtcttaaatgttccatcaaaggaacaggccctgggcaaatgattcgcattaacaacaatgtattcaaaactaacgttcataatgttggggttgatgtttatctcgacgagaaaggcaagaagaaagcctacgaaagaaagaacccgcggttgagcaaacatttcattgagccaccaccacagcctaatggaagggttagcttcactctcaaacggagagacatggtaactgtcgagggagaagatgcaatttataggatcaagaagctcggtacatctcccactatagaggccgtcgtaggatcagacggaaagacccggactgtgtcagcaacaaaacttaccaaggctaacagtgctgagctcgaggagggagctgataagcgcaccgccgatggttccgagttcgaaagccccaagaagaagaggaaagtctaaccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggaaagacccagcatccgtgttacagttaagaaattaattgtaaaacgcctatacagtgaagggatatacgcttgggtttgtccagcctgagcctctatgccagaaatggcgccttcatcgtgggttaggacatttaatttttttcatagttaagccagtatctgctcc

SEQ ID NO: 1208 - protein, 236 aa, unidentified
  source 1..236: note = W90A
MASETGPSAGDPTLRRRIEPWEFEVFFDPRELRRETCLLYEIQWGTSHRRWRKSGKNTTNHAEVNFIEKLTSERQFCPSVRCSITWFLSASPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1209 - protein, 236 aa, unidentified
  source 1..236: note = W90F
MASETGPSAGDPTLRRRIEPWEFEVFFDPRELRRETCLLYEIQWGTSHRRWRKSGKNTTNHAEVNFIEKLTSERQFCPSVRCSITWFLSFSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1210 - protein, 236 aa, unidentified
  source 1..236: note = W90H
MASETGPSAGDPTLRRRIEPWEFEVFFDPRELRRETCLLYEIQWGTSHRRWRKSGKNTTNHAEVNFIEKLTSERQFCPSVRCSITWFLSHSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1211 - protein, 236 aa, unidentified
  source 1..236: note = W90Y
MASETGPSAGDPTLRRRIEPWEFEVFFDPRELRRETCLLYEIQWGTSHRRWRKSGKNTTNHAEVNFIEKLTSERQFCPSVRCSITWFLSYSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1212 - protein, 236 aa, unidentified
  source 1..236: note = Y120F
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLFYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1213 - protein, 236 aa, unidentified
  source 1..236: note = Y120H
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLHYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1214 - protein, 236 aa, unidentified
  source 1..236: note = Y121F
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYFHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1215 - protein, 236 aa, unidentified
  source 1..236: note = Y121H
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYHHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1216 - protein, 236 aa, unidentified
  source 1..236: note = Y121Q
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYQHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1217 - protein, 236 aa, unidentified
  source 1..236: note = Y121A
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYAHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1218 - protein, 236 aa, unidentified
  source 1..236: note = Y121D
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYDHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1219 - protein, 236 aa, unidentified
  source 1..236: note = Y121W
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYWHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1220 - protein, 236 aa, unidentified
  source 1..236: note = H122Y
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYYMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1221 - protein, 236 aa, unidentified
  source 1..236: note = H122F
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYFMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1222 - protein, 236 aa, unidentified
  source 1..236: note = H122I
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYIMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1223 - protein, 236 aa, unidentified
  source 1..236: note = H122A
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYAMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1224 - protein, 236 aa, unidentified
  source 1..236: note = H122W
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYWMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1225 - protein, 236 aa, unidentified
  source 1..236: note = H122D
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYDMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1226 - protein, 237 aa, unidentified
  source 1..237: note = Replace with hAID loop7
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYFCEDRKAEPEGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1227 - protein, 238 aa, unidentified
  source 1..238: note = Replace with 139_86 loop 7
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYLYYIQKEENQNGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1228 - protein, 187 aa, unidentified
  source 1..187: note = Truncate from 188 to end
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIIL

SEQ ID NO: 1229 - protein, 236 aa, unidentified
  source 1..236: note = Y121T
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYTHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1230 - protein, 237 aa, unidentified
  source 1..237: note = Replace with a smaller section of hAID loop7
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYFCEDRKANRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1231 - protein, 237 aa, unidentified
  source 1..237: note = Replace with a smaller section of hAID loop7
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYFHEDRKANRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1232 - protein, 236 aa, unidentified
  source 1..236: note = R33A
MASETGPSAGDPTLRRRIEPWEFEVFFDPRELARETCLLYEIQWGTSHRRWRKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1233 - protein, 236 aa, unidentified
  source 1..236: note = R34A
MASETGPSAGDPTLRRRIEPWEFEVFFDPRELRAETCLLYEIQWGTSHRRWRKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1234 - protein, 236 aa, unidentified
  source 1..236: note = R34K
MASETGPSAGDPTLRRRIEPWEFEVFFDPRELRKETCLLYEIQWGTSHRRWRKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1235 - protein, 236 aa, Una virus
  source 1..236: note = H122A R33A
MASETGPSAGDPTLRRRIEPWEFEVFFDPRELARETCLLYEIQWGTSHRRWRKSGKNTTNHAEVNFIEKLTSERQFCPSVRCSITWFLSWSPCWECSQAIQEFLSQHPNVTLVIYVARLYYAMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1236 - protein, 236 aa, unidentified
  source 1..236: note = H122A R34A
MASETGPSAGDPTLRRRIEPWEFEVFFDPRELRAETCLLYEIQWGTSHRRWRKSGKNTTNHAEVNFIEKLTSERQFCPSVRCSITWFLSWSPCWECSQAIQEFLSQHPNVTLVIYVARLYYAMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1237 - protein, 236 aa, unidentified
  source 1..236: note = R52A
MASETGPSAGDPTLRRRIEPWEFEVFFDPRELRRETCLLYEIQWGTSHRRWAKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1238 - protein, 236 aa, unidentified
  source 1..236: note = H122A R52A
MASETGPSAGDPTLRRRIEPWEFEVFFDPRELRRETCLLYEIQWGTSHRRWAKSGKNTTNHAEVNFIEKLTSERQFCPSVRCSITWFLSWSPCWECSQAIQEFLSQHPNVTLVIYVARLYYAMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1239 - protein, 236 aa, unidentified
  source 1..236: note = N57G (Shown to have lower off target activity in A3A)
MASETGPSAGDPTLRRRIEPWEFEVFFDPRELRRETCLLYEIQWGTSHRRWRKSGKGTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1240 - protein, 236 aa, unidentified
  source 1..236: note = N57G H122A
MASETGPSAGDPTLRRRIEPWEFEVFFDPRELRRETCLLYEIQWGTSHRRWRKSGKGTTNHAEVNFIEKLTSERQFCPSVRCSITWFLSWSPCWECSQAIQEFLSQHPNVTLVIYVARLYYAMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWR

SEQ ID NO: 1241 - protein, 200 aa, unidentified
  source 1..200: note = Replace with A3A loop7
MFDYTTDKEFLRTLLWTGIEWPKRTYLIAVVKTAYGKEIFKKGFKNKPKDGHAEEIMLNDYDFRKTVAGDRYIEIILTLNYSPCSECAKILRTFYESHKKKITKFIIQFSQIYDYDPLYKEGLRNLYEAGVTLQAMNPGSWGEVGIDLNVMGAKDRGRITERDKNTDDELYSVLFPYKKEQVQDTSVDELSSRFNKQIKF

SEQ ID NO: 1242 - protein, 211 aa, unidentified
  source 1..211: note = E123A
MATTLEESKDFIENLFTTGIKGTVWPKKTYLIVVIKNRRGEVIFRKKYQTLPNRCGFLPNENHTERQMLDDQEFKECLETGEVCEIILTSNYSPCKDCAKDLKNFYEECTELRLTIQFSHPYATNDGKDHLKGLKNLDRAGITLEAMTDESRLDVLRNEEHLLDMVLKFMFDLDPRRVEERDVATKEKLKKLRRTDSEAERFAAKMKNLNL

SEQ ID NO: 1243 - protein, 211 aa, unidentified
  source 1..211: note = E123Q
MATTLEESKDFIENLFTTGIKGTVWPKKTYLIVVIKNRRGEVIFRKKYQTLPNRCGFLPNENHTERQMLDDQEFKECLETGEVCEIILTSNYSPCKDCAKDLKNFYEECTELRLTIQFSHPYQTNDGKDHLKGLKNLDRAGITLEAMTDESRLDVLRNEEHLLDMVLKFMFDLDPRRVEERDVATKEKLKKLRRTDSEAERFAAKMKNLNL

SEQ ID NO: 1244 - protein, 246 aa, unidentified
  source 1..246: note = Replace with hAID loop7
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYFCEDRKAEPEGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1245 - protein, 247 aa, unidentified
  source 1..247: note = Replace with 139_86 loop 7
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYLYYIQKEENQNGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1246 - protein, 245 aa, unidentified
  source 1..245: note = W127F
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYFHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1247 - protein, 245 aa, unidentified
  source 1..245: note = W127H
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYHHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1248 - protein, 245 aa, unidentified
  source 1..245: note = W127Q
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYQHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1249 - protein, 245 aa, unidentified
  source 1..245: note = W127A
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYAHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1250 - protein, 245 aa, unidentified
  source 1..245: note = W127D
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYDHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1251 - protein, 245 aa, unidentified
  source 1..245: note = R39A
MSSDVVFCWSTGPSAGDTTLRRRIEPWEFKDSFDPHQLAKETRLLSEVWWGKSSRPWRESRQNATHHVEMNFIEKFTSERHLRPHVCCSITWFLSWSPCWECAKAIREFVSQHPKVRLVIYVARLYWHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1252 - protein, 245 aa, unidentified
  source 1..245: note = K40A
MSSDVVFCWSTGPSAGDTTLRRRIEPWEFKDSFDPHQLRAETRLLSEVWWGKSSRPWRESRQNATHHVEMNFIEKFTSERHLRPHVCCSITWFLSWSPCWECAKAIREFVSQHPKVRLVIYVARLYWHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1253 - protein, 245 aa, unidentified
  source 1..245: note = H128A
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYWALDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1254 - protein, 245 aa, unidentified
  source 1..245: note = N63G
MSSDVVFCWSTGPSAGDTTLRRRIEPWEFKDSFDPHQLRKETRLLSEVWWGKSSRPWRESRQGATHHVEMNFIEKFTSERHLRPHVCCSITWFLSWSPCWECAKAIREFVSQHPKVRLVIYVARLYWHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1255 - protein, 245 aa, unidentified
  source 1..245: note = R58A
MSSDVVFCWSTGPSAGDTTLRRRIEPWEFKDSFDPHQLRKETRLLSEVWWGKSSRPWAESRQNATHHVEMNFIEKFTSERHLRPHVCCSITWFLSWSPCWECAKAIREFVSQHPKVRLVIYVARLYWHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAE

SEQ ID NO: 1256 - protein, 229 aa, unidentified
  source 1..229: note = Replace with hAID loop7
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYFCEDRKAEPEGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1257 - protein, 228 aa, unidentified
  source 1..228: note = Replace with 139_86 loop 7
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYYIQKEENQNGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1258 - protein, 228 aa, unidentified
  source 1..228: note = H121F
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYFHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1259 - protein, 228 aa, unidentified
  source 1..228: note = H121Y
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYYHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1260 - protein, 228 aa, unidentified
  source 1..228: note = H121Q
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYQHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1261 - protein, 228 aa, unidentified
  source 1..228: note = H121A
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYAHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1262 - protein, 228 aa, unidentified
  source 1..228: note = H121D
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYDHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1263 - protein, 228 aa, unidentified
  source 1..228: note = H121W
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYWHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1264 - protein, 228 aa, unidentified
  source 1..228: note = N57G (Shown to have lower off target activity in A3A)
MSSETGPAVVDPTLRRRIEPQEFEVFFDPRELRKETCLLYEISWGGRRSIWRHTSRGTDKHVEINFIEKLTSQRSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1265 - protein, 228 aa, unidentified
  source 1..228: note = R33A
MSSETGPAVVDPTLRRRIEPQEFEVFFDPRELAKETCLLYEISWGGRRSIWRHTSRNTDKHVEINFIEKLTSQRSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1266 - protein, 228 aa, unidentified
  source 1..228: note = K34A
MSSETGPAVVDPTLRRRIEPQEFEVFFDPRELRAETCLLYEISWGGRRSIWRHTSRNTDKHVEINFIEKLTSQRSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1267 - protein, 228 aa, unidentified
  source 1..228: note = H122A
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYHAMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1268 - protein, 228 aa, unidentified; identical to SEQ ID NO: 1261
  source 1..228: note = H121A

SEQ ID NO: 1269 - protein, 228 aa, unidentified
  source 1..228: note = R52A
MSSETGPAVVDPTLRRRIEPQEFEVFFDPRELRKETCLLYEISWGGRRSIWAHTSRNTDKHVEINFIEKLTSQRSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGM

SEQ ID NO: 1270 - protein, 224 aa, unidentified
  source 1..224: note = K16 through P25 of pgtA3H replaces G20 through P26
MAEGGQDSAFEFMKTLLETKRRVNKPYYPNFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1271 - protein, 218 aa, unidentified
  source 1..218: note = S170 through D138 of pgtA3H replaces K196 to V215
MAEGGQDSAFEFMKTLLETGIDDCWPNFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVSQAIKRRLERIKSRSVDEKTKSL

SEQ ID NO: 1272 - protein, 221 aa, unidentified
  source 1..221: note = P26R
MAEGGQDSAFEFMKTLLETGIDDCWRNFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1273 - protein, 221 aa, unidentified
  source 1..221: note = P26A
MAEGGQDSAFEFMKTLLETGIDDCWANFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1274 - protein, 221 aa, unidentified
  source 1..221: note = N27R
MAEGGQDSAFEFMKTLLETGIDDCWPRFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1275 - protein, 221 aa, unidentified
  source 1..221: note = N27A
MAEGGQDSAFEFMKTLLETGIDDCWPAFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1276 - protein, 221 aa, unidentified
  source 1..221: note = W44A (equivalent to R52A)
MAEGGQDSAFEFMKTLLETGIDDCWPNFTNLIADIKTKDGEVIAWKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1277 - protein, 221 aa, unidentified
  source 1..221: note = W45A (equivalent to R52A)
MAEGGQDSAFEFMKTLLETGIDDCWPNFTNLIADIKTKDGEVIWAKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1278 - protein, 221 aa, unidentified
  source 1..221: note = K49G (equivalent to N57G)
MAEGGQDSAFEFMKTLLETGIDDCWPNFTNLIADIKTKDGEVIWWKKYGSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1279 - protein, 221 aa, unidentified
  source 1..221: note = S50G (equivalent to N57G)
MAEGGQDSAFEFMKTLLETGIDDCWPNFTNLIADIKTKDGEVIWWKKYKGRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1280 - protein, 221 aa, unidentified
  source 1..221: note = R51G (equivalent to N57G)
MAEGGQDSAFEFMKTLLETGIDDCWPNFTNLIADIKTKDGEVIWWKKYKSGNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1281 - protein, 221 aa, unidentified
  source 1..221: note = R121A (equivalent to H121A)
MAEGGQDSAFEFMKTLLETGIDDCWPNFTNLIADIKTKDGEVIWWKKYKSRNSHAEIQMLNDVEFKDEIGKVKDDKTKKVDIILTLNYSPCSECADKLKKFYEDNKSLIQKFTIRFSRLYAINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1282 - protein, 221 aa, unidentified
  source 1..221: note = I122A (equivalent to H122A)
MAEGGQDSAFEFMKTLLETGIDDCWPNFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRANVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1283 - protein, 221 aa, unidentified
  source 1..221: note = N123A (equivalent to H122A)
MAEGGQDSAFEFMKTLLETGIDDCWPNFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRIAVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1284 - protein, 221 aa, unidentified
  source 1..221: note = Y88F (equivalent to W90F)
MAEGGQDSAFEFMKTLLETGIDDCWPNFTNLIADIKTKDGEVIWWKKYKSRNSHAEIQMLNDVEFKDEIGKVKDDKTKKVDIILTLNFSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1285 - protein, 221 aa, unidentified
  source 1..221: note = Y120F (equivalent to Y120F)
MAEGGQDSAFEFMKTLLETGIDDCWPNFTNLIADIKTKDGEVIWWKKYKSRNSHAEIQMLNDVEFKDEIGKVKDDKTKKVDIILTLNYSPCSECADKLKKFYEDNKSLIQKFTIRFSRLFRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1286 - protein, 201 aa, unidentified
  source 1..201: note = P22R
MFDYTTDKEFLRTLLWTGIEWRKRTYLIAVVKTAYGKEIFKKGFKNKPKDGHAEEIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPYKKEQVQDTSVDELSSRFNKQIKF

SEQ ID NO: 1287 - protein, 201 aa, unidentified
  source 1..201: note = P22A
MFDYTTDKEFLRTLLWTGIEWAKRTYLIAVVKTAYGKEIFKKGFKNKPKDGHAEEIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPYKKEQVQDTSVDELSSRFNKQIKF

SEQ ID NO: 1288 - protein, 201 aa, unidentified
  source 1..201: note = K23A
MFDYTTDKEFLRTLLWTGIEWPARTYLIAVVKTAYGKEIFKKGFKNKPKDGHAEEIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPYKKEQVQDTSVDELSSRFNKQIKF

SEQ ID NO: 1289 - protein, 201 aa, unidentified
  source 1..201: note = K41R
MFDYTTDKEFLRTLLWTGIEWPKRTYLIAVVKTAYGKEIFRKGFKNKPKDGHAEEIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPYKKEQVQDTSVDELSSRFNKQIKF

SEQ ID NO: 1290 - protein, 201 aa, unidentified
  source 1..201: note = K41A
MFDYTTDKEFLRTLLWTGIEWPKRTYLIAVVKTAYGKEIFAKGFKNKPKDGHAEEIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPYKKEQVQDTSVDELSSRFNKQIKF

SEQ ID NO: 1291 - protein, 178 aa, unidentified
  source 1..178: note = truncate K179 and onwards
MFDYTTDKEFLRTLLWTGIEWPKRTYLIAVVKTAYGKEIFKKGFKNKPKDGHAEEIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPY

SEQ ID NO: 1292 - protein, 179 aa, unidentified
  source 1..179: note = Insert hAID loop 7 and truncate K179 onwards
MFDYTTDKEFLRTLLWTGIEWPKRTYLIAVVKTAYGKEIFKKGFKNKPKDGHAEEIMLNDYDFRKTVAGDRYIEIILTLNYSPCSECAKILRTFYESHKKKITKFIIQFSQLYFCEDRKAEPEGLRNLYEAGVTLQAMNPGSWGEVGIDLNVMGAKDRGRITERDKNTDDELYSVLFPY

SEQ ID NO: 1293 - protein, 178 aa, unidentified
  source 1..178: note = E54D and truncation
MFDYTTDKEFLRTLLWTGIEWPKRTYLIAVVKTAYGKEIFKKGFKNKPKDGHADEIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPY

SEQ ID NO: 1294 - protein, 201 aa, unidentified
  source 1..201: note = E54A Mutate catalytic E residue
MFDYTTDKEFLRTLLWTGIEWPKRTYLIAVVKTAYGKEIFKKGFKNKPKDGHAAEIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPYKKEQVQDTSVDELSSRFNKQIKF

SEQ ID NO: 1295 - protein, 201 aa, unidentified
  source 1..201: note = Mutate neighboring E residue
MFDYTTDKEFLRTLLWTGIEWPKRTYLIAVVKTAYGKEIFKKGFKNKPKDGHAEAIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPYKKEQVQDTSVDELSSRFNKQIKF

SEQ ID NO: 1296 - protein, 201 aa, unidentified
  source 1..201: note = E54AE55A Mutate both catalytic E residues
MFDYTTDKEFLRTLLWTGIEWPKRTYLIAVVKTAYGKEIFKKGFKNKPKDGHAAAIMLNDYDFRKTVAGDRYIEIILTLNYSPCSECAKILRTFYESHKKKITKFIIQFSQLYYIQKEENQNGLRNLYEAGVTLQAMNPGSWGEVGIDLNVMGAKDRGRITERDKNTDDELYSVLFPYKKEQVQDTSVDELSSRFNKQIKF

SEQ ID NO: 1297 - protein, 211 aa, unidentified
  source 1..211: note = K30A
MPGEIEIEHHDSKIRHMYETVLDHRHGWNAAMTTNLICRINSEDTPLIIQNAHGNKHAEELLLDELNQRDKSLLTTITIYTNNSPCSNKGHDCARQLIKFLNENTHVIMVFYVTNLYKIRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1298 - protein, 211 aa, unidentified
  source 1..211: note = K30R
MPGEIEIEHHDSKIRHMYETVLDHRHGWNRAMTTNLICRINSEDTPLIIQNAHGNKHAEELLLDELNQRDKSLLTTITIYTNNSPCSNKGHDCARQLIKFLNENTHVIMVFYVTNLYKIRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1299 - protein, 211 aa, unidentified
  source 1..211: note = M32A
MPGEIEIEHHDSKIRHMYETVLDHRHGWNKAATTNLICRINSEDTPLIIQNAHGNKHAEELLLDELNQRDKSLLTTITIYTNNSPCSNKGHDCARQLIKFLNENTHVIMVFYVTNLYKIRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1300 - protein, 211 aa, unidentified
  source 1..211: note = M32K
MPGEIEIEHHDSKIRHMYETVLDHRHGWNKAKTTNLICRINSEDTPLIIQNAHGNKHAEELLLDELNQRDKSLLTTITIYTNNSPCSNKGHDCARQLIKFLNENTHVIMVFYVTNLYKIRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1301 - protein, 211 aa, unidentified
  source 1..211: note = Y117A
MPGEIEIEHHDSKIRHMYETVLDHRHGWNKAMTTNLICRINSEDTPLIIQNAHGNKHAEELLLDELNQRDKSLLTTITIYTNNSPCSNKGHDCARQLIKFLNENTHVIMVFYVTNLAKIRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1302 - protein, 211 aa, unidentified
  source 1..211: note = K118A
MPGEIEIEHHDSKIRHMYETVLDHRHGWNKAMTTNLICRINSEDTPLIIQNAHGNKHAEELLLDELNQRDKSLLTTITIYTNNSPCSNKGHDCARQLIKFLNENTHVIMVFYVTNLYAIRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1303 - protein, 211 aa, unidentified
  source 1..211: note = I119A
MPGEIEIEHHDSKIRHMYETVLDHRHGWNKAMTTNLICRINSEDTPLIIQNAHGNKHAEELLLDELNQRDKSLLTTITIYTNNSPCSNKGHDCARQLIKFLNENTHVIMVFYVTNLYKARRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1304 - protein, 211 aa, unidentified
  source 1..211: note = I119H
MPGEIEIEHHDSKIRHMYETVLDHRHGWNKAMTTNLICRINSEDTPLIIQNAHGNKHAEELLLDELNQRDKSLLTTITIYTNNSPCSNKGHDCARQLIKFLNENTHVIMVFYVTNLYKHRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1305 - protein, 211 aa, unidentified
  source 1..211: note = R120A
MPGEIEIEHHDSKIRHMYETVLDHRHGWNKAMTTNLICRINSEDTPLIIQNAHGNKHAEELLLDELNQRDKSLLTTITIYTNNSPCSNKGHDCARQLIKFLNENTHVIMVFYVTNLYKIARVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1306 - protein, 211 aa, unidentified
  source 1..211: note = R121A
MPGEIEIEHHDSKIRHMYETVLDHRHGWNKAMTTNLICRINSEDTPLIIQNAHGNKHAEELLLDELNQRDKSLLTTITIYTNNSPCSNKGHDCARQLIKFLNENTHVIMVFYVTNLYKIRAVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1307 - protein, 211 aa, unidentified
  source 1..211: note = P46A
MPGEIEIEHHDSKIRHMYETVLDHRHGWNKAMTTNLICRINSEDTALIIQNAHGNKHAEELLLDELNQRDKSLLTTITIYTNNSPCSNKGHDCARQLIKFLNENTHVIMVFYVTNLYKIRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1308 - protein, 211 aa, unidentified
  source 1..211: note = P46R
MPGEIEIEHHDSKIRHMYETVLDHRHGWNKAMTTNLICRINSEDTRLIIQNAHGNKHAEELLLDELNQRDKSLLTTITIYTNNSPCSNKGHDCARQLIKFLNENTHVIMVFYVTNLYKIRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1309 - protein, 211 aa, unidentified
  source 1..211: note = N29A
MPGEIEIEHHDSKIRHMYETVLDHRHGWAKAMTTNLICRINSEDTPLIIQNAHGNKHAEELLLDELNQRDKSLLTTITIYTNNSPCSNKGHDCARQLIKFLNENTHVIMVFYVTNLYKIRRVSCKSEEHYSLVSQADFKANNTGLKDMMKHGRCVVSAFSYAVWVELLNIAPVSEVFKSQLLARYRTILDTNDRSREEEDNRIRSDLAYIR

SEQ ID NO: 1310 - protein, 194 aa, unidentified
  source 1..194: note = Loop 7 from MG138-20
MPGEIEIEHHDSKIRHMYETVLDHRHGWNKAMTTNLICRINSEDTPLIIQNAHGNKHAEELLLDELNQRDKSLLTTITIYTNNSPCSNKGHDCARQLIKFLNENTHVIMVFYVTRLYYTEFKANNTGLKDMMKHGRCVVSAFSYAVWVELLNIAPVSEVFKSQLLARYRTILDTNDRSREEEDNRIRSDLAYIR

SEQ ID NO: 1311 - protein, 212 aa, unidentified
  source 1..212: note = Loop 7 from MG139-12
MPGEIEIEHHDSKIRHMYETVLDHRHGWNKAMTTNLICRINSEDTPLIIQNAHGNKHAEELLLDELNQRDKSLLTTITIYTNNSPCSNKGHDCARQLIKFLNENTHVIMVFYVTGLYPGAGEAEGERGAATRPEDLAELKANNTGLKDMMKHGRCVVSAFSYAVWVELLNIAPVSEVFKSQLLARYRTILDTNDRSREEEDNRIRSDLAYIR

SEQ ID NO: 1312 - protein, 183 aa, unidentified
  source 1..183: note = R27A
MYKKKLRGMYMSKKAFKYHFDPRESPAATYLLCVIQWGCNGLPWIHWVKNGRSHAERYFLQKVFKMRRSNNNINCSITLYLSWSPCRNCCYEMQYFLKKHPNVNICIYLARLYYTEDEEICKALKDLSEKKVIISVMKIEDYIYCWKTFVSGNAAAGSWFKDFESQINKNHFQLKRILEVSPL

SEQ ID NO: 1313 - protein, 183 aa, unidentified
  source 1..183: note = N50G
MYKKKLRGMYMSKKAFKYHFDPRESPRATYLLCVIQWGCNGLPWIHWVKGGRSHAERYFLQKVFKMRRSNNNINCSITLYLSWSPCRNCCYEMQYFLKKHPNVNICIYLARLYYTEDEEICKALKDLSEKKVIISVMKIEDYIYCWKTFVSGNAAAGSWFKDFESQINKNHFQLKRILEVSPL

SEQ ID NO: 1314 - protein, 221 aa, unidentified
  source 1..221: note = Loop 7 from MG138-20
MAEGGQDSAFEFMKTLLETGIDDCWPAFTNLIADIKTKDGEVIWWKKYKSRNSHAEIQMLNDVEFKDEIGKVKDDKTKKVDIILTLNYSPCSECADKLKKFYEDNKSLIQKFTIRFSRLYYTEVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1315 - protein, 241 aa, unidentified
  source 1..241: note = Loop 7 from MG139-12
MAEGGQDSAFEFMKTLLETGIDDCWPAFTNLIADIKTKDGEVIWWKKYKSRNSHAEIQMLNDVEFKDEIGKVKDDKTKKVDIILTLNYSPCSECADKLKKFYEDNKSLIQKFTIRFSGLYPGAGEAEGERGAATRPEDLAELNVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSL

SEQ ID NO: 1316 - DNA, 41 bp, unidentified
  source 1..41: mol_type = unassigned DNA; note = nucleotide sequences of 5-FAM-labeled ssDNAs
attattattattagcatatttatttatttatttatttattt

SEQ ID NO: 1317 - DNA, 41 bp, unidentified
  source 1..41: mol_type = unassigned DNA; note = nucleotide sequences of 5-FAM-labeled ssDNAs
attattattattaccatatttatttatttatttatttattt

SEQ ID NO: 1318 - DNA, 39 bp, unidentified
  source 1..39: mol_type = unassigned DNA; note = nucleotide sequences of 5-FAM-labeled ssDNAs
attattattattaacatttatttatttatttatttattt

SEQ ID NO: 1319 - DNA, 41 bp, synthetic construct
  source 1..41: mol_type = other DNA; note = nucleotide sequences of 5-FAM-labeled ssDNAs
attattattattatcatatttatttatttatttatttattt

SEQ ID NO: 1320 - DNA, 80 bp, unidentified
  source 1..80: mol_type = unassigned DNA; note = AC vs GC Substrate
  modified_base 30: mod_base = OTHER; note = Cyanine5.5 modified nucleotide
attattattattagcattattattattatattattattattagacattattattattatattattattattatattatta

SEQ ID NO: 1321 - DNA, 80 bp, unidentified
  source 1..80: mol_type = unassigned DNA; note = TC v CC substrate
attattattattatcattattattattatattattattattagccattattattattatattattattattatattatta

SEQ ID NO: 1322 - protein, 1481 aa, unidentified
  source 1..1481: note = sequences of cytidine base editors.
MPGEIEIEHHDSKIRHMYETVLDHRHGWNKAMTTNLICRINSEDTPLIIQNAHGNKHAEELLLDELNQRDKSLLTTITIYTNNSPCSNKGHDCARQLIKFLNENTHVIMVFYVTNLYKIRRVSCKSEEHYSLVSQADFKANNTGLKDMMKHGRCVVSAFSYAVWVELLNIAPVSEVFKSQLLARYRTILDTNDRSREEEDNRIRSDLAYIRSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1323 - protein, 1491 aa, unidentified
  source 1..1491: note = N27A
MAEGGQDSAFEFMKTLLETGIDDCWPAFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSLSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1324 - protein, 1506 aa, unidentified
  source 1..1506: note = sequences of cytidine base editors.
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYHMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWRSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1325 - protein, 1491 aa, unidentified
  source 1..1491: note = sequences of cytidine base editors.
MAEGGQDSAFEFMKTLLETGIDDCWPNFTNLIADIKTKDGEVIWWKKYKSRNSHAEIQMLNDVEFKDEIGKVKDDKTKKVDIILTLNYSPCSECADKLKKFYEDNKSLIQKFTIRFSRLYRINVQENKDGLKDLDRAGITLEAMTPESWFDVLMTDKSWLESMSTDQKSSFETIMKKKDKFDRVMKLFGLNHDRVKKRDADTSEGLKKLIMEEVVEKTKSLSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1326 - protein, 1486 aa, unidentified
  source 1..1486: note = sequences of cytidine base editors.
MAELEESKDFIKNLITTGIRDTDWPKKTYLIVVGKNKTGKVIWKKKYQTLPNKFGSLPNENHTERQMLDDQEFEDQVETGEVRKIILTSNYSPCKECAKGLINFFQERTELELTIRFSHLYEERRVNHLEGLKDLDREERITLEAMTEKSWLDVLTNEEHFLDMVLTFMFDLNPCKVEQRDVATAKKLKKLLKSDSGFELGIVDKMRRMPFESDSDSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1327 - protein, 1498 aa, unidentified
  source 1..1498: note = sequences of cytidine base editors.
MSSETGPAVVDPTLRRRIEPQEFEVFFDPRELRKETCLLYEISWGGRRSIWRHTSRNTDKHVEINFIEKLTSERSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRQGTLFTLVFQRCHYQRIPPPIVWARGMSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1328 - protein, 1515 aa, unidentified
  source 1..1515: note = sequences of cytidine base editors.
MSSDVVFCWSTGPSAGDTTLRRRIEPWEFKDSFDPHQLRKETRLLSEVWWGKSSRPWRESRQNATHHVEMNFIEKFTSERHLRPHVCCSITWFLSWSPCWECAKAIREFVSQHPKVRLVIYVARLYWHLDEQNRQGLRALVAGGVHVQIMSDSDYGYCWRNFVNYPPGQEAAWPRFLPVWTALYALELSCILLSLPPCLRISRRRQNQLTFFQVILKNCHYRAIPPLVLSAAGMMHPSVAWCWAESACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1329 - protein, 1485 aa, unidentified
  source 1..1485: note = sequences of cytidine base editors.
MAEGGNSKDVILKEWLSTGINSKYTGSEWTSVTHLVVYIKDNDGTGIYAKYFRNNKDNHAEINMIKHSEFEKMVRKGKVDITVNSNYSPCSDCASSLITFYGKYKEYINSFTIRFAFLYFINKTKNRDGLKNLKEAGIILEAMTEKSWFEVFMLFKFSSTLADQVRKKDEDTRATLSKLLNEVPETGQVAGAGEEPGIEELTQKTKTVEVTAKNTSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1330 - protein, 1629 aa, unidentified
  source 1..1629: note = sequences of cytidine base editors.
MTFLRMDIPDGPLAGRPVRSRMDGVHPVHGRVLALQRAAGNAATTSALGTVQRSVVDEIARMKPDQLVVALQELNPKAAATNLWVTVDGKPVTELISRPAGFESLWPIQSGRGPHAEERFAQGVMPLLAARQPRYILLEITKSPCPSCTALLSQLVGEHPGTRFELHMLGLYPGAGEAEGERGAATRPEDLAELERKLQAKLLDLRAVIDRLTDEQWRKRFKYPKHTKIPIGTRIAALKFARSVHTTMVEARLKLGERQDQTAYGAKLKDLEDKFAELAAFLTAKKADATASARHEPYPAHETGRPTPAAETVTDLDRWTAIKAECPDLQLSEQTYGEYFLYSSHRAFTWFYVHNSLPESACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1331 - protein, 1527 aa, unidentified
  source 1..1527: note = sequences of cytidine base editors.
MAEGGQDLAFEFMKILLKTGSGNCWPKSTKLIVDIKTKNGEITRRKKYQTSKSHKHAEFQMLNDKVFKDEIEKVKDDKTKKTEKTKTTDKTEKVDIILTLNYSPCSECADKLIEFYKDKRSLIRKFTIRFSRLFRINIQANIDGLKDLNSAGITLKAMTEKSWCDVLMPEESSSFEKVMKLYDLDPVMIRKRDLDTRKTLQELLGKDQSDSSDESGSSHESGPSHESESSDSDAQILVSDMEKINLKAILTDKSVYSSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1332 - protein, 1481 aa, unidentified
  source 1..1481: note = sequences of cytidine base editors.
MATTLEESKDFIENLFTTGIKGTVWPKKTYLIVVIKNRRGEVIFRKKYQTLPNRCGFLPNENHTERQMLDDQEFKECLETGEVCEIILTSNYSPCKDCAKDLKNFYEECTELRLTIQFSHPYETNDGKDHLKGLKNLDRAGITLEAMTDESRLDVLRNEEHLLDMVLKFMFDLDPRRVEERDVATKEKLKKLRRTDSEAERFAAKMKNLNLSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1333 - protein, 1454 aa, unidentified
  source 1..1454: note = sequences of cytidine base editors.
MAFMKILLKTGIDGYWPKFTNLIVVIKTEDGEVIWTKTYQTSKSHVHTEIQMLTDKKFKDEVEKVKADKTKKVVIILTSNYSPCRECADKLKEFYEDKKSLIQGFTIRFSRLYRINEQDNKNGLKDLYIKGITLEAMTEKSWFDQVMKLFDLDPDKVRKRDADTSKGLKELEIEALADKVEKNLSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1334 - protein, 1467 aa, unidentified
  source 1..1467: note = sequences of cytidine base editors.
MFDFYFCALTFLFCFLDDFLNDLLWTGVKGKNRPKRTYLIASIKDNDGKDIFNERFKNTPFGKHAEKTMLCDGDFRKAVAYHHNMEIVLTLNYSPCSSCADDLKLFYETYRNIGNLTIQFSFLYNIQEEENRSGLRNLSNAGVTLQAMNANLWREVGIDLESMASEDERRISGRDKNTGDMLYAVLYRYQNEQDQDTSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1335 - protein, 1450 aa, unidentified
  source 1..1450: note = sequences of cytidine base editors.
MVLFDYAIDEEFLTTLLSTGLPDTDLPKRTYLIAVVKTDNGEEIYNERFKNIPNGEHAEERMLNDEDFLHAVVDHHNVKIILTSNYSPCSKCARKLISFYKKRERKIRKFIIQFPFLFKKQEEENRSGLRSLNEVGVTLRAMNADSWFKVGIDFMDVEDKERITERDKKTAYKLKQVLFTSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1336 - protein, 1520 aa, unidentified
  source 1..1520: note = sequences of cytidine base editors.
MKGLIECLLFCVSAWSRILACREILTTGSGSNWPHSTALCCFIYKTYKNKKDGQNQIFQKIYQNEPQEQHAEEKMLAIEPDSDFISTIKDKNAVHDIVLVLSYSPCYSCANKLIVFYEKYKNPYSISSFKIRFSQLYKIYGRIPKEEKEKNKKGLKDMLLAGITLETMTDKHWFDLFSRMVFGVNPDSCRIRDNSMERKLDTLKKEAEAAAEVDVDTDADRASDADADTEEEEDLQTMMHTMVLTDEADGSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1337 - protein, 1603 aa, unidentified
  source 1..1603: note = sequences of cytidine base editors.
MYISRRALGYHFDPRVSPRDTFLLCRLQWGARGRRWKHWVRKDRHHAEVYFLEKIFEPRRFNNAHCSITWYLSWSPCANCCYRIVQFLMKHSYVSIDIRVARLYFIEDETTRQGLEELVSCARVRLTVMDTEGKVPFVLWNWEGVNWWKIEPDEFKTNYSPDHRPRVVYLLYEIRWRRGTIWRNWCSNNIDQHAEVNFLENCFKAKPSVSCSITWFLSTAPCAKCSRRILKFLTAHPKVTLEIYAAKLFRHLEIRNRQGLMDLAVNGVILRIMNLADYSYCWKQFVAYQRGQEVYWPQSFSPYIFLNWRELHHILLVSRYLKRTLPVKSNGRSSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1338 - protein, 1527 aa, unidentified
  source 1..1527: note = sequences of cytidine base editors.
MAEGGQDLAFEFMKILLKTGIGKCWPKFTNLIADIKTKDGEVTWRKKYQTSKSHKHAEFQMLNDKEFKDEIGKVKADKTKRTEKTNKTEKTNKTEKTEKVDIILTLNYSPCGECADELVEFYKDKRSLIRKFTIRFSRLFRINIQANIDGLKDLNSAGITLKAMTEKSWYDVLMPEESSGFEEVMELYDLDPVMIRKRDLDTRKTLQELLGKDQSDSSDESGSSHESGPSHESESSDSDAQLLVSDMEKLKFESDSDSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1339 - protein, 1506 aa, unidentified
  source 1..1506: note = H122A
MASETGPSAGDPTLRRRIEPWEFEVFFDPRELRRETCLLYEIQWGTSHRRWRKSGKNTTNHAEVNFIEKLTSERQFCPSVRCSITWFLSWSPCWECSQAIQEFLSQHPNVTLVIYVARLYYAMDQRNRQGLRDLVNSGVTIQIMSVPEYCYCWRNFVNFPPGQEAHWPRYQPQWMALYELELHCIILSLPPCLKISRRCQKQLTFFGLTLQNCHYQAIPPHILLATGLVLPFVPWRSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1340 - protein, 1576 aa, unidentified
  source 1..1576: note = sequences of cytidine base editors.
MAFWRTKKWSYMYRKHNSSIPDEMDVCSMFDSSDESDSSDESDSSDEADSSDESDSSDEADSSDECDSSEESDSADKSKTGYKRIKSKHPRRTYNVEDKKENGNIIQHIYNTGLDHDDWSEAMDTFLVCKINGVHNPKIMRNNSENHAEQLLIQNLRKKYKEKKMPFKLTVYINNSPCSMCAKALENFLNKNKNVKLTFYVTNMYHIKRNSCLKARHFEHLNSIPKKSHKANSEGLRDLLRHKRCNIKAFNMGVWKELLNTVDVLSKVKTKLIGGYNRIQYANKRSRGYEDDLIKKDLTYLKSYKKSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1341 - protein, 1453 aa, unidentified
  source 1..1453: note = sequences of cytidine base editors.
MYKKKLRGMYMSKKAFKYHFDPRESPRATYLLCVIQWGCNGLPWIHWVKNGRSHAERYFLQKVFKMRRSNNNINCSITLYLSWSPCRNCCYEMQYFLKKHPNVNICIYLARLYYTEDEEICKALKDLSEKKVIISVMKIEDYIYCWKTFVSGNAAAGSWFKDFESQINKNHFQLKRILEVSPLSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1342 - protein, 1463 aa, unidentified
  source 1..1463: note = sequences of cytidine base editors.
MAAVSARGPSSRENNQGWKMQPEDFQRNYSPRQNGRVYLLYEIRWRSSSIWRNWCSNNPEQHAEVNFLENHFNNQPQTPCCITWFLSASPCGNCCRRILKFLRSHPNVTLVICAAKLFRHLDIRNRRGLRSLMMNGVAIRIMNLEDYRYCWRNFVAHQPGQDDYWPQNVTLYFILNSIELLHIFLDLPPFLANSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1343 - protein, 1499 aa, unidentified
  source 1..1499: note = sequences of cytidine base editors.
MTTMRGPAAGDATLRRRIEPWDFQDFFDPRDLRRETCLLYEINWGGRHSVWRHTGKNTSNHVEVNFIEKFTSERYYSPSARCSIIWFLSWSPCWECSKAIIEFLHQHRNVTLFIYVARLFHHTDLRNRQGIRDLISSGVTIQIMTEPEYCYCWRYFVNYPPGSEVHWPRYPRQWMMLYVLELQCIILGLPSCVKILRRHQNQLTIFTLDLQNCHYQMIPPHILLATGLISACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1344 - protein, 1537 aa, unidentified
  source 1..1537: note = sequences of cytidine base editors.
MTDKFAPLPLIKMESVPSPGDRSTDSYQTDNSDEDDASDCDFESCERFSYTPYKVNDIIHKMWDTVLDHNNGYQQNLASSTYLVYKIEGMHKPGILKNDTMHAEKQLISIIQGNFTAPLKIIIYIYINNSPCAECATLLKKFMVDNQKIKMVLYIAHLYNIKRSSCVLRAALKKESRHVDCIPKAFHEKNYLGLRNLMSIGGHRCRIEAFKKKVWEDLLALTGISTQMMDNYNRRKKGYDRSRQNEDKRIKKDLNEIKRKPKPPYMYSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1345 - protein, 1497 aa, unidentified
  source 1..1497: note = sequences of cytidine base editors.
MWNTVLNHGYGYSELGGSLASETYLVCKMDGEPKPIIKGNNIEKHAEMQLVDDLKQMELLQKKVTVYINNSPCAACAKKLKDYLEENEGIHLTLYVTHLYNIRRMSCQLRVNALEKERHIYYCEEHEANYQGLKDLMSLGGNRCEIKAFTVDVWRELHEVMGLTTDDYQQRMKKYNTMIQDPTQDPKNKKNHDRSRKREDINIKNDLNHLKENVDPWNGIRKIFLKRSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1346 - protein, 1519 aa, unidentified
  source 1..1519: note = sequences of cytidine base editors.
MAKGGVESGEELFENLDKSGNKEKLDTMWNTVLNHGYGYSELGGSLAKTTYLVCKIDGVPEPIIIGNDEGKHAEKQLVDILKEMTLLKNEVTVYINNSPCAACANEFKDYLEENEDIHLTLYVTHLYNIRRRSCQDKADTQNERHMKTIDKDEHVDNYKGLRDLMNLEDNRCKIEAFTEDVWRQLHEVMGLTEDCQQRMITYAETKITDPKNKEKNHDRSRKTEDINIKNDLIHLQKNVDPWHGIKKYYSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1347 - protein, 1442 aa, unidentified
  source 1..1442: note = sequences of cytidine base editors.
MDDELECFLFSGNYGNLNANWPHRTVMVFRSTINGTPGVYQVIHNDPQNDHAEIIFINQVNIPPEATEIEIEMFISYSPCNTCADALIVWINNLTMQVSIAIKFFSFYKNETRGLILLSQVDGITLDVFRGEEAWENFFQCIRRTDFTKYKKRIRKRKDREDVDDTKLQGIISACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1348 - protein, 1498 aa, unidentified
  source 1..1498: note = sequences of cytidine base editors.
MSSETGPAVVDPTLRRRIEPQEFEVFFDPRELRKETCLLYEISWGGRRSIWRHTSRNTDKHVEINFIEKLTSQRSFRPSARCSITWFLSWSPCGECSKAITEFLSQHPNVTLFIYVARLYHHMDPGNRQGLRNLICRGVTVQIMTEQEYCYCWKNFVNYPPSNEVYWPRFPNVWMRLYMLELLCIILGLPPCLRILRRNQRHDTLFTLVFQRCHYQRIPPPIIWARGMSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1349 - protein, 1498 aa, unidentified
  source 1..1498: note = sequences of cytidine base editors.
MSSQTGPAVVDPTLRRRIEPQDFEAFFDPRELRKETCLLYEISWGGRHNTWRHTSRNTDKHVEINFIKKLTSERSFRPSARCSITWFLSWSPCWECSKAITEFLSQHPNVTLFIYVARLYHHMDPGNRQGLRNLVCRGVTVQIMTEQEYCYCWKNFVNYPPSNEVYWPRFPNVWMKLYILELLCIILGLPPCLRILRRNQCQATLFTLVFQGCHFQRIPPPIFWATGMSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1350 - protein, 1506 aa, unidentified
  source 1..1506: note = sequences of cytidine base editors.
MTSEKGPSTGDATLRRRIEPWEFEVFFNPGELRKETCMFYEIKWGTSQKIWRNSSKNTTNHVEVNFIEKFTAERHFCPSISCSITWFLSWSPCWECSKAIREFLSQHPNTTLVIYTARLFQHMDQQNRQGLRDLINSGVTVQIMTISEYCYCWRNFVNYSPKEETHWPKYQPLLMMLYALELHCIILSLPPCLKISRRYQKQLTFFNLILQNCHYQTIPPHILLSLGLIQPSVTWRSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1351 - protein, 1475 aa, unidentified
  source 1..1475: note = sequences of cytidine base editors.
MERSSGRDWLDECCPRGCKYTSNYRGPMKGLFQKAFYFHFENLHYADHRRKTFLCFEVTRLQDNKFRKGMFINQVGPYRLHAELRFLSWFHDSWLCPYASYEVTWYMSWSPCEECMEELAAFLANHRNVTLTIYVARLYYYQEPTCGEGLQALLNEGASVNIMFFRDFLDCWRRFVYNGNEYFEPWPHLHQNSLKYFHILEELLESACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1352 - protein, 1644 aa, unidentified
  source 1..1644: note = sequences of cytidine base editors.
MYRRKMRGMYISKRALRIHFDPCKFPKETYLLCELQWRGSTKFWQHWVRNDHDYEDCHAEQYFLDEVFEPRSYNICDMTWYLSWSPCRECCDIIRDFLEEQPNVNIDIRVARLYYTNIPRYRDGLRELHSLEGVTIKAMEAEDYNYCWETFIQPGVNYYFSPNNFKSEIQRNRTKLEDILQGLHLYARITVLLVLFFRWKMQPRDFQRNYSPRQNGRVYLLYEIRWRRGSIWRNWCSNNHEQHAEVNFLENHFSVRPQTPCSITWFLSTSPCGKCSRRILEFLRSHPNVTLVIYAAKLFRHHDNRNRQGLRNLIMNGVTLRIMNLEDYRYCWRNFVAYQTGEDDYWPQNVTLYFLLNSTELLHIFWGLPPFLANSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1353 - protein, 1601 aa, unidentified
  source 1..1601: note = sequences of cytidine base editors.
MAEGGQDLKFDFEFMKILLETGIDNCWPRFTNLIVDISDGELTWKRIYQTSDSHTESQMLDDKEFKAKFKVEEDKADKITDTEKTKKTDKAEKVYKTEMVIKAEKVGKAEKVDKTEKVDKTEKVDKTEKVDKTEKVDKTEKVDKTENVDKTEKVDKTENVDKAEKIDKPEEVDIILTSNYSPCRECAVKLIDFYEEKKGLIRNFIIRFSRLYRITEQENKDGLKDLNRAGNSAGITLEAMTEKSWCDVLMTDKSWLDSMSTQQKSSFEKMMNEKDCFDKVMKLFGLVPNKVKQRDAATSKDLTDLLAQDKKTQDSRLKQIISSKTRHRHKKSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1354 - protein, 1449 aa, unidentified
  source 1..1449: note = sequences of cytidine base editors.
MRKETGMYISKAALKHNFNPHETPKDTYLLCKLQWGETGTPWIHWVRNERYHHAESYFLEKIFKMRRSSNYVKCNITWYLSWSPCADCCHKILNFLKRHSNVNIDIYVARLYYIEDEEIRQCLKNLVSLAEVTIAVMKIEDYIYCQKKFIQGGDDDDSWTVSFQPEISKNRLKLKDVFESACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1355 - protein, 1535 aa, unidentified
  source 1..1535: note = sequences of cytidine base editors.
MYIINSRIKRLVLLGTRMLQIVYCVFYLHSFLSGSVTFLEFDLRIYPYFYILMIILFSFFFVLFCFLDDFLNELLWTGVRDTKLPNRTYLIASIKSKDGEDIFNKRFKNEPFLKHAEAVMLCDDDFGDAVAVHHDIEITLTLNYSPCSSCACELKKFYEKNRNIRNPIIQFSFLYRIEEEKNQHGLRNLREAGITLQAMNANSWREVGIDLELMALEDKEIITERDEDQADMLNKVLSTYESEHDQDTSNDDELSSLFQSQLKFLSACSGSETPGTSESATPESMSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEGSGGSSMSKTIKDLEEFAAEKLGYDIVFQESISMEPQEVEHLITTDEKSVLVNSTYDDNKEITISMISTPHPEYRPIALIIQDMEGEVQRKELGSGGSPKKKRKVGGSPKKKRKVGSG

SEQ ID NO: 1356 - protein, 972 aa, unidentified
  source 1..972: note = MG68-4_MG34-1 (D10A)
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAEDPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1357 - protein, 972 aa, unidentified; identical to SEQ ID NO: 676
  source 1..972: note = MG68-4 (D109N)_MG34-1 (D10A)

SEQ ID NO: 1358 - protein, 1172 aa, unidentified
  source 1..1172: note = MG68-4 (D109N homodimer_32aa linker)_MG34-1 (D10A)
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGSSGGSSGSETPGTSESATPESSGGSSGGSAMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1359 - protein, 1192 aa, unidentified
  source 1..1192: note = MG68-4_(D109N homodimer_52aa linker)_MG34-1 (D10A)
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSSGGSSGGSSGGSSGGSSGSETPGTSESATPESSGGSSGGSSGGSSGGSSGSAMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1360 - protein, 1204 aa, unidentified
  source 1..1204: note = MG68-4_(D109N homodimer_64aa linker)_MG34-1 (D10A)
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGSSGGSSGSETPGTSESATPESSGGSSGGSSGGSSGGSSGSETPGTSESATPESSGGSSGGSAMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1361 - protein, 1145 aa, unidentified
  source 1..1145: note = MG68-4_(D109N homodimer_5aa linker)_MG34-1 (D10A)
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGGGGSAMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1362 - protein, 972 aa, unidentified; identical to SEQ ID NO: 677
  source 1..972: note = TadA*8.8m_MG34-1 (D10A)

SEQ ID NO: 1363 - protein, 1369 aa, unidentified
  source 1..1369: note = 3-68_DIV30M_CMCL1
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAEDPKTGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1364 - protein, 1369 aa, unidentified; identical to SEQ ID NO: 1157
  source 1..1369: note = 3-68_DIV30M_CMCL2

SEQ ID NO: 1365 - protein, 1369 aa, unidentified
  source 1..1369: note = 3-68_DIV30M_CMCL3
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1366 - protein, 1369 aa, unidentified
  source 1..1369: note = 3-68_DIV30M_CMCL4
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1367 - protein, 1369 aa, unidentified
  source 1..1369: note = 3-68_DIV30M_CMCL5
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGAENPKTGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1368 - protein, 1369 aa, unidentified
  source 1..1369: note = 3-68_DIV30M_CMCL6
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKRGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1369 - protein, 1369 aa, unidentified
  source 1..1369: note = 3-68_DIV30M_CMCL7
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNNQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1370 - protein, 1369 aa, unidentified
  source 1..1369: note = 3-68_DIV30M_CMCL9
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1371 - protein, 1369 aa, unidentified
  source 1..1369: note = 3-68_DIV30M_CMCL10
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1372 - protein, 1369 aa, unidentified
  source 1..1369: note = 3-68_DIV30M_CMCL11
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGAENPKTGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1373 - protein, 1369 aa, unidentified
  source 1..1369: note = 3-68_DIV30M_CMCL12
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKRGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1374 - protein, 1369 aa, unidentified
  source 1..1369: note = 3-68_DIV30M_CMCL13
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNNQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1375 - protein, 1369 aa, unidentified
  source 1..1369: note = 3-68_DIV30M_CMCL14
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSRFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1376 - protein, 1369 aa, unidentified
  source 1..1369: note = 3-68_DIV30M_CMCL15
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1377 - protein, 1369 aa, unidentified
  source 1..1369: note = 3-68_DIV30M_CMCL16
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKTGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1378 - protein, 1369 aa, unidentified
  source 1..1369: note = 3-68_DIV30M_CMCL17
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKRGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1379 - protein, 1369 aa, unidentified
  source 1..1369: note = 3-68_DIV30M_CMCL18
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKTGACGSVMDIARHPALNNQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1380 - protein, 1369 aa, unidentified
  source 1..1369: note = 3-68_DIV30M_CMCL20
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKTGACGSVMDIARHPALNHQLQVDGGVMAAPCARLLSDFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1381 - protein, 1369 aa, unidentified
  source 1..1369: note = 3-68_DIV30M_CMCL22
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGAENPKRGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1382 - protein, 1369 aa, unidentified
  source 1..1369: note = 3-68_DIV30M_CMCL23
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGAENPKTGACGSVMDIARHPALNNQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1383 - protein, 1369 aa, unidentified
  source 1..1369: note = 3-68_DIV30M_CMCL25
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGAENPKTGACGSVMDIARHPALNHQLQVDGGVMAAPCARLLSDFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1384 - protein, 1369 aa, unidentified
  source 1..1369: note = 3-68_DIV30M_CMCL28
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKRGACGSVMDIARHPALNNQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1385 - protein, 1369 aa, unidentified
  source 1..1369: note = 3-68_DIV30M_CMCL29
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKRGACGSVMDIARHPALNHQLQVDGGVMAAPCARLLSRFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1386 - protein, 1369 aa, unidentified
  source 1..1369: note = 3-68_DIV30M_CMCL30
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKRGACGSVMDIARHPALNHQLQVDGGVMAAPCARLLSDFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1387 - protein, 1369 aa, unidentified
  source 1..1369: note = 3-68_DIV30M_CMCL34
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNNQLQVDGGVMAAPCARLLSRFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1388 - protein, 1369 aa, unidentified
  source 1..1369: note = 3-68_DIV30M_CMCL35
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNNQLQVDGGVMAAPCARLLSDFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1389 - protein, 1369 aa, unidentified
  source 1..1369: note = 3-68_DIV30M_CMCL40
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSRFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1390 - protein, 1369 aa, unidentified
  source 1..1369: note = 3-68_DIV30M_CMCL56
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKRGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1391 - protein, 1369 aa, unidentified
  source 1..1369: note = 3-68_DIV30M_CMCL57
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKTGACGSVMDIARHPALNNQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1392 - protein, 1369 aa, unidentified
  source 1..1369: note = 3-68_DIV30M_CMCL58
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKRGACGSVMDIARHPALNNQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1393 - protein, 1369 aa, unidentified; identical to SEQ ID NO: 1391
  source 1..1369: note = 3-68_DIV30M_CMCL59

SEQ ID NO: 1394 - protein, 1369 aa, unidentified
  source 1..1369: note = 3-68_DIV30M_CMCL60
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKRGACGSVMDIARHPALNNQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1395 - protein, 1369 aa, unidentified
  source 1..1369: note = 3-68_DIV30M_CMCL61
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKRGACGSVMDIARHPALNNQLQVDGGVMAAPCARLLSRFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1396 - protein, 1369 aa, unidentified
  source 1..1369: note = 3-68_DIV30M_CMCL62
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDGYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKRGACGSVMDIARHPALNNQLQVDGGVMAAPCARLLSRFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1397 - protein, 1369 aa, unidentified
  source 1..1369: note = 3-68_DIV30M_CMCL63
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDEYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKRGACGSVMDIARHPALNNQLQVDGGVMAAPCARLLSRFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1398 - protein, 1369 aa, unidentified
  source 1..1369: note = 3-68_DIV30M_CMCL64
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGAENPKRGACGSVMDIARHPALNNQLQVDGGVMAAPCARLLSRFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1399 - protein, 1369 aa, unidentified
  source 1..1369: note = 3-68_DIV30M_CMCL65
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKRGACGSVMDIARHPALNNQLQVDGGVMAAPCARLLSRFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1400 - protein, 1369 aa, unidentified
  source 1..1369: note = 3-68_DIV30M_CMCL66
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKTGACGSVMDIARHPALNNQLQVDGGVMAAPCARLLSRFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1401 - protein, 1369 aa, unidentified
  source 1..1369: note = 3-68_DIV30M_CMCL67
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKRGACGSVMDIARHPALNHQLQVDGGVMAAPCARLLSRFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1402 - protein, 1369 aa, unidentified
  source 1..1369: note = 3-68_DIV30M_CMCL68
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKRGACGSVMDIARHPALNNQLQVDGGVMAAPCARLLSDFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1403 - protein, 1369 aa, unidentified
  source 1..1369: note = 3-68_DIV30M_CMCL69
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNGTDGYWMGEALKLAQKAWDEGEVPVGAILVRKGEVIGHGWNRSIGSHDPSAHAEIMAIREAGVRIGNYRMLDTVLYSTFEPCAMCAGALVHGRISRLVFGAENPKRGACGSVMDIARHPALNNQLQVDGGVMAAPCARLLSRFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1404 - protein, 1369 aa, unidentified
  source 1..1369: note = 3-68_DIV30M_CMCL70
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGAENPKRGACGSVMDIARHPALNNQLQVDGGVMAAPCARLLSRFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1405 - protein, 1369 aa, unidentified
  source 1..1369: note = 3-68_DIV30M_CMCL71
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKRGACGSVMDIARHPALNNQLQVDGGVMAAPCARLLSRFFRWRRRQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1406 - protein, 1369 aa, unidentified; identical to SEQ ID NO: 1400
  source 1..1369: note = 3-68_DIV30M_CMCL72

SEQ ID NO: 1407 - protein, 1369 aa, unidentified; identical to SEQ ID NO: 1401
  source 1..1369: note = 3-68_DIV30M_CMCL73

SEQ ID NO: 1408 - protein, 1369 aa, unidentified; identical to SEQ ID NO: 1402
  source 1..1369: note = 3-68_DIV30M_CMCL74

SEQ ID NO: 1409 - protein, 1369 aa, unidentified; identical to SEQ ID NO: 1403
  source 1..1369: note = 3-68_DIV30M_CMCL75

SEQ ID NO: 1410 - protein, 1369 aa, unidentified; identical to SEQ ID NO: 1157
  source 1..1369: note = 3-68_DIV30M

SEQ ID NO: 1411 - protein, 1601 aa, unidentified
  source 1..1601: note = 3-68_DIV30D
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGSSGGSSGSETPGTSESATPESSGGSSGGSSGGSSGGSSGSETPGTSESATPESSGGSSGGSAMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1412 - protein, 1369 aa, unidentified; identical to SEQ ID NO: 1365
  source 1..1369: note = 3-68_DIV30_M_EPMG68-4_D7G_D10G_B

SEQ ID NO: 1413 - protein, 1369 aa, unidentified; identical to SEQ ID NO: 1369
  source 1..1369: note = 3-68_DIV30_M_EPMG68-4_H129N_B

SEQ ID NO: 1414 - protein, 1601 aa, unidentified
  source 1..1601: note = 3-68_DIV30_HT_EPMG68-4_D109N+D7G-D10G_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGSSGGSSGSETPGTSESATPESSGGSSGGSSGGSSGGSSGSETPGTSESATPESSGGSSGGSAMTDSQNGTDGYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1415 - protein, 1601 aa, unidentified
  source 1..1601: note = 3-68_DIV30_HT_EPMG68-4_D109N+H129N_B
MAPKKKRKVGGGGSSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLGTSGSETPGTSESATPESMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGSSGGSSGSETPGTSESATPESSGGSSGGSSGGSSGGSSGSETPGTSESATPESSGGSSGGSAMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNNQLQVDGGVMAAPCARLLSDFFRWRRAQKKAARDNSSGNSGSETPGTSESATPESGTSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEGSGGKRPAATKKAGQAKKKK

SEQ ID NO: 1416 - RNA, 123 nt, unidentified
  source 1..123: mol_type = unassigned RNA; note = MG34-1_633 guide
gttacagttaagaaattaattgtaaaacgcctatacagtgaagggatatacgcttgggtttgtccagcctgagcctctatgccagaaatggcgccttcatcgtgggttaggacatttaatttt

SEQ ID NO: 1417 - RNA, 123 nt, unidentified; identical to SEQ ID NO: 1416
  source 1..123: mol_type = unassigned RNA; note = MG34-1_634 guide

SEQ ID NO: 1418 - RNA, 89 nt, unidentified; identical to SEQ ID NO: 1188
  source 1..89: mol_type = unassigned RNA; note = sgRNA68

SEQ ID NO: 1419 - RNA, 20 nt, unidentified
  source 1..20: mol_type = unassigned RNA; note = MG34-1_633 target sequence
gaacacaaagcatagactgc

SEQ ID NO: 1420 - RNA, 20 nt, unidentified
  source 1..20: mol_type = unassigned RNA; note = MG34-1_634 target sequence
gggaaagacccagcatccgt

SEQ ID NO: 1421 - RNA, 21 nt, unidentified
  source 1..21: mol_type = unassigned RNA; note = sgRNA68 target sequence
acagacaaaactgtgctagac

SEQ ID NO: 1422 - DNA, 6863 bp, synthetic construct
  source 1..6863: mol_type = other DNA; note = Expression of MG34-1 adenine base editor, pPE798
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcgatgaccgacagccagaacgacaccgacgagtactggatgggcgaagccctgaagctggcccagaaagcttgggatgaaggcgaagtgcctgtgggcgccattcttgtgcgaaagggcgaagtgatcggccacggctggaatagatccatcggcagccacgatccaagcgctcacgccgagatcatggccattagagaggccggcgtccggatcggcaactacagaatgctggacaccgtgctgtacgtgaccctggaaccttgcgctatgtgtgctggcgctctggtgcacggcagaatcagcagactggtgtttggcgccgagaatcctaagaccggcgcctgtggaagcgtgatggatatcgccagacatcccgctctgaaccaccagctgcaagtggatggcggagtgatggctgccccttgtgctagactgctgagcgacttcttcaggtggcggagagcccagaagaaggccgccagagataacagcagcggcaactcaggcgggtcttccggcggcagtagtgggagcgaaacaccgggcacaagtgagagcgcaacaccggaatcatctggcggttcaagcggcggatccgcgatgaccgactctcaaaatgacactgatgaatactggatgggtgaggctcttaaactggcgcagaaagcctgggacgaaggtgaagtgcctgttggcgccatcctggtccggaaaggggaagtgattgggcacgggtggaatcgaagcattgggtcacacgatccatccgctcatgcagaaattatggcgatcagagaggccggagttcgaatcggaaattatagaatgcttgataccgtgctgtacgtgaccttagagccctgcgcaatgtgcgcaggtgccctggttcatggaagaattagccggctggtgtttggagcagagaaccccaagactggggcttgtggatctgttatggacattgcaaggcatccagccctgaaccatcaactccaagttgatggcggagtcatggctgccccctgcgcccgcttattgtccgacttcttccgctggcgccgtgcgcaaaagaaagctgccagagataactctagcggaaatggtacctcaggcgggtcttccggcggcagtagtgggagcgaaacaccgggcacaagtgagagcgcaacaccggaatcatctggcggttcaagcggcggatccatggaacgcgaattggtcttgggaattgcgtatggcggaaagtacactggtctggccgtcgtcgataggagacataaccaagtgctctacgcaaatagactgaagatgagggatgatgtcgccggcattcttaaagaccgccggaagcaaaggggcatcaggcgcaccgcccaaacaaagaagaagcgtttgcgagaacttaagaattatctcaaaagtataggttacaatgagtcaaccgctacttttgaaacggtttactcactggctcacaagaggggctatgactatgctgatatgcccgaggaaaagactagtgaagaaattgaagcaatggacgtggaagagcggaaacaatgggaaaaggagaaacaagagtgggaagagactaaacgaaactctagacatcgtaaagaagtcgtgaaggatgtccacaaagctatgattgaaggcagggctactgaggaacaaattaaaagagtggaacggatatttaataaacaatacagacccaagcgattcaataatcgcatcctgacaaaatgcaaggtcgaagactgcggagtcaacacccctttgaggaagaatgttagggatctcctgatagaaaatattgtgaggttcttcccaatagaacaatctgaaaaggataacttgaaggacgccgtgttggataagaatagaagggaagaagtcaagtccttctttaggaaacataaaaccgatgagcatatacgcaaacaggtgtatgatatagccgataacaagctctctggcaggacagtcttttgcaaggagcacattctggaacacacagaacattctaaggaagagaggaaagtattcagactcgctccgagtcttaagaccaaaatagagaatgtccttgccgtaattaaagatgaaatcctgcctaagttcaccgtcaataaagtcgtgatggagtctaacaatttcgacatcgctgccaaaactcaaggcaagaaacggctcgccaaagaagagtatggtaagggaccacgtgaaggcaaagaaaccaggaaagaagctctcctgcgggagactgatggcagatgcatatattgtgggaagtcaatagatatctccaatgctcatgacgaccatatctttcctcgaaaggccggcggactgaacatcttcgcaaatcttgtagcatgctgtgccgtgtgtaatgagaataagaaagggcggacacctctggaatcaggtattagcccaaagccagagatcatcgctttcatgaagaatgatctcaagaagaagatccttgaagacgcccgaaacataaacacggtggatttcaataagtacatgtcacatgccagcattggctggagatatatgagagaccgacttagggaatctgccgggaataagaagctcccgattgagaggcaaagcgggatctatacggcatactttcggagatggtggggattcaagaaggagcggggcaatacactccaccatgccttggatgctgttatcctggcgtcccggaaaggatatagcgatgacgggttggttgacatgacattgaaacctaaatacaacaaaggtggagagttcgatccagaaaagcacctgccagaacctattgagttcaaaatggacaaaggttccaggggatctgcacttcatgatagaaaccccttgtcctataagaagggaattattactcgtaggttcatggtcactgaaatcgagtgcgggaaagaggatgacgtgatctcagaaacttacagagagaaactcaaagaggcattcaagcgctttgataccaagaaaggaaaatgtctgaccgacaaggaagccaaagaggccggattctgcatcaagaagaatgagctggtgatgagtcttaaatgttccatcaaaggaacaggccctgggcaaatgattcgcattaacaacaatgtattcaaaactaacgttcataatgttggggttgatgtttatctcgacgagaaaggcaagaagaaagcctacgaaagaaagaacccgcggttgagcaaacatttcattgagccaccaccacagcctaatggaagggttagcttcactctcaaacggagagacatggtaactgtcgagggagaagatgcaatttataggatcaagaagctcggtacatctcccactatagaggccgtcgtaggatcagacggaaagacccggactgtgtcagcaacaaaacttaccaaggctaacagtgctgagctcgaggagggagctgataagcgcaccgccgatggttccgagttcgaaagccccaagaagaagaggaaagtctaaccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgaagcttcatagttaagccagtatctgctcc

SEQ ID NO: 1423 - DNA, 7993 bp, synthetic construct
  source 1..7993: mol_type = other DNA; note = Expression of MG3-6_3-8 adenine base editor, pPE1159
ctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgcgatggcccccaagaagaagagaaaagtcggcggaggcggcagcagcaccgacatgaagaactacagaatcggcgtggccgtgggcgacagaagcgttggactggctgccatcgagttcgacgatgacggactgcccatccagaagctggccctggtcacattcagacacgacggtggactggaccccaccaagaacaagacccctatgagcagaaaagagacacggggaatcgccagacggaccatgagaatgaacagagagcgcaagagaaggctgaggaacctggacaacgtgctggaaaacctgggctactctgtgcctgagggccctgagcctgagacatacgaggcctggacatctagagccctgctggcctctatcaaactggcctctgccgacgagctgaacgaacaccttgtcagagccgtgcggcacatggccagacatagaggatgggccaatccttggtggtccctggaccagctggaaaaggccagccaagagcctagcgagacattcgagatcatcctggccagagccagagagctgttcggcgagaaggtgcccgctaatcctacactgggaatgctgggagccctggccgctaacaatgaggtgctgctgaggcccagggacgagaagaagagaaagaccggatacgtgcggggcacccctctgatgtttgctcaagttcgacagggcgatcagctggccgagctgcggagaatttgtgaagtgcagggcatcgaggaccagtacgaggctctgagactgggcgtgttcgaccacaagcacccctacgtgcccaaagaaagagtgggcaaagaccctctgaaccccagcaccaacagaaccatcagagccagcctggaatttcaagagttccgcatcctggacagcgtggccaatctgagagtgcggatcggcagcagagccaagagggaactgacagaggccgagtatgatgccgccgtggaattcctgatggactacgccgacaaagagcagcctagctgggccgatgtggccgagaaaattggcgtgcccggcaacagactggtggcccctgttctggaagatgtgcagcagaaaacagccccttacgacagaagcagcgccgcctttgagaaggccatgggcaagaaaaccgaggccagacagtggtgggagtccaccgatgatgaccagctgagaagcctgctgattgccttcctggtggacgccaccaacgacacagaagaagccgctgctgaagccggcctgagcgagctgtataagtcttggcctgccgaggaaagagaggccctgtccaacatcgacttcgagaagggcagagtggcctacagccaagaaaccctgagcaagctgagcgagtacatgcacgagtacagagtgggactgcacgaggctagaaaggccgtgttcggagtggatgatacctggcggcctcctctggataagctggaagaacctacaggacagcctgccgtggacagagtgctgaccatcctgagaagattcgtgctggactgcgagcggcaatggggcagacctagagccatcaccgtggaacacacacggacaggcctgatgggcccaacacagagacagaagatcctgaacgagcagaagaagaaccgggccgacaacgagagaatccgggatgagctgagagaatctggcgtggacaacccctccagagccgaagttcggagacacctgatcgtgcaagagcaagagtgccagtgcctgtactgcggcaccatgatcaccaccaccacaagcgagctggaccacatcgttcctagagccggtggcggcagcagcagaagggaaaatctggccgctgtgtgcagagcctgcaacgccaagaagaaacgcgagctgttctacgcctgggctggcccagtgaagtcccaagagacaatcgagagagtcagacagctgaaggcctttaaggacagcaagaaagccaagatgttcaagaaccagatccgccggctgaaccagaccgaggccgatgagcctatcgacgaaagaagcctggccagcacatcttacgccgctgtggccgttagagagcggctggaacagcacttcaacgaaggcctggcactggacgacaagtccagagtggtgctggatgtgtatgccggcgctgtgaccagagagtctcgtagagctggcggcatcgacgagcggattctgctgagaggcgagcgggacaagaacagattcgatgtgcggcatcacgccgtggacgctgctgttatgaccctgctgaacagatccgtggctctgaccctggaacagagatcacagctgaggcgggccttctacgagcaaggactggacaaactggacagggatcagctgaagcccgaagaggactggcggaacttcatcggactgggtacctcggggagtgaaacacccggcacatccgaaagtgcgacacctgaatctatgaccgactctcaaaatgacactgatgaatactggatgggtgaggctcttaaactggcgcagaaagcctgggacgaaggtgaagtgcctgttggcgccatcctggtccggaaaggggaagtgattgggcacgggtggaatcgaagcattgggtcacacgatccatccgctcatgcagaaattatggcgatcagagaggccggagttcgaatcggaaattatagaatgcttgataccgtgctgtacgtgaccttagagccctgcgcaatgtgcgcaggtgccctggttcatggaagaattagccggctggtgtttggagcagaggaccccaagactggggcttgtggatctgttatggacattgcaaggcatccagccctgaaccatcaactccaagttgatggcggagtcatggctgccccctgcgcccgcttattgtccgacttcttccgctggcgccgtgcgcaaaagaaagctgccagagataactctagcggaaatagcggatctgagacacctggcacaagcgagtctgccacacctgagtctggtaccagcctggcctctcaagagaagttcctggaatggaagaaagtgaccaccgtgctgggcgacctgctggctgaagccatcgaggatgattctatcgccgtggtgtcccctctgaggctgaggccacaaaatggcagagtgcacaaggacacaatcgccgccgtgaagaagcagacactgggatctgcttggagcgccgacgccgtgaaaagaatcgtggaccccgagatctacctggctatgaaggatgccctgggcaagtccaaggtgctgccagaggatagcgcccggacactggaactgtccgatggcagatacctggaagccgacgacgaggtgctgttcttcccaaagaacgccgccagcatcctgacacctagaggcgtggcagagatcggcggctctattcaccatgccagactgtatagctggctgaccaagaagggcgagctgaagatcggcatgctgagagtgtacggcgccgagtttccctggctgatgagagagtctggatctcacgacgtgctgcggatgcctattcaccctggcagccagagcttccgggacatgcaggataccaccagaaaagccgtggaaagcagcgaggctgtggaattcgcctggatcacccagaacgatgagctggaattcgagcccgaggactacattgcccacggcggaaaggacgaactgcggcagtttctggaattcatgcctgagtgccgttggagagtggacggcttcaagaagaattaccagatcagaatcaggcccgccatgctgagcagagagcagctgcctagcgacatccagcggagactggaaagcaagaccctgaccgagaacgagtccctgctgctgaaagccctggatacaggactggtggtggccatcggaggactgctgcctctgggaaccctgaaagtgatccggcggaacaatctgggcttccccaggtggcgcggaaacggaaatctgcccaccagctttgaagtgcggagcagcgctctgagagccctgggagttgaaggatctggcggaaaaagacctgccgccacaaagaaagccggacaggccaagaaaaagaagtgaggatcccatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgaccctagggtcgactctcagtacaatctgctctgatgccgaagcttgagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccacagacaaaactgtgctagacagttgagaatcgaaagattcttaataaggcatccttccgatgctgacttctcaccgtccgttttccaataggagcgggcggtatgtttttttcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgtttcatagttaagccagtatctgctcc

SEQ ID NO: 1424 - protein, 623 aa, unidentified; identical to SEQ ID NO: 1113
  source 1..623: note = MG35-1 ABE

SEQ ID NO: 1425 - DNA, 8629 bp, synthetic construct
  source 1..8629: mol_type = other DNA; note = Expression of MG35-1 ABE and sgRNA targeting the CAT gene
ttaattaatttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgttttttgtctcagccaatccctgggtgagtttcaccagttttgatttaaacgtggccaatatggacaacttcttcgcccccgttttcaccatgggcaaatattatacgcaaggcgacaaggtgctgatgcccctggcgattcaggtgcactacgccgtctgtgatggcttccatgtcggcagaatgcttaatgaattacaacagtactgcgatgagtggcagggcggggcgtaatttttttaaggcagttattggtgcccttaaacgcctggtgctacgcctgaataagtgaagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgactcgagtgcggccgcaagcttgtcgacggagctcgaattcggatcctaatacgactcactatagcgtagtgcacctgaatcgccgtaactgtccattaataacttagtcaactaagttattataaagttacccgcctaagttcttcgagaactacgttagggatgaaaacataggtactctcgcgatgcttctccagtccgagactctacggggaactattaaacaggtccgatggaaaggccagtgtagtttccattcaaaaccgtcctataacattggctaggagactattacccgcgtcagcggagctaggtaacaatttatgcaaagagtaaaaaaaaaccccgcttcggcggggtttttttttagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatccgaaataattttgtttaactttaagaaggagatataccccgcggatgcagcgcgttttcgtgctggaccacaacaagcagccactgatgccctgtcatccagcgcgcgcccgtaagttacttaagaaaggcaaagccgcggtgtatcgtcgttatccgtttgccatcatcatgactcatcgtgtcggcggagacctgcagactgttgagatcaagttcgccccgggcagtcgtaccacaggtattgcgctggtcggcgacttcgatcgcggtaaagaggtgatttgggccgggaatctgaatcaccgcggccaccaaattaagtcgaacctgaattcccgccgcgcgattcgtcgtgctcgtcgcaaccgcaaaacccgctaccgccaagctcgcttcaacaatcgtcgccgtccgaagggatggttaccgccgtctctgcgtagccgtgtagacaacacgaagaactggatgcacaaattggcgcgtctggcgccgcttacccagattgccgtggagaccgtgcgcttcgacacccaaaagctccagaagcctgagatctcaggcgtcgagtaccagcagggcgaactggctggatacgaattgcgcgagtatctcctggagaagtggggacgcgagtgcgcatactgcggcgctaagaacatccctctggagatcgagcatattcaggcccgcagtaagggcggctcagaccgtgtgagtaatctgacgctggcctgtacaccgtgcaacattgacaaaggaaacaaagacatcaaggaattcctgagcctgaaaccaaagcgcctgaagaagattcaggcaaccgccaccgccccgctgaaggacgccgccgcggttaacgcgacacgttatgcaaccggtaacgtactgaagtgctttagcttgccaatcacgtttagctcgggcggccgtacgaagttcaatcgcgttaaacttggttatctgaaggatcactggatcgatgccgcgtgcgttggagagtctggcagccaggtggtcatcccaaaggcaattaccccgctgatcattaccagcaaaggccgcggctctcgccaaaagtgccgcatgaaccagtatggattcccccgcacgggtccaaagaagcagaaacaagtgaaaggattccagacaggtgacatcgttaaggcgattgttaccaagggcaagaaaattggtacctacatcggccgcgtcgtagttcgttcacgcgggagtttcgacatcgggtctggagagaagaaggtcggatcaatcagctacaagtactgtcagctgttgcagcgcgccgacggatatgaatatacgtcggggagtgaaacacccggcacatccgaagcttcgacacctgaatctgcctccgaggttgaatttagtcatgaatattggatgcgccacgcgctgacgttagccaaacgtgctcgtgatgagcgcgaagttccagtcggggccgtcttggtccttaacaatcgtgtcattggcgaggggtggaaccgcgctattgggctgcacgatccaacagcgcatgctgagattatggccttgcgtcaaggagggttagtaatgcaaaactaccgtcttattgatgctacgttatactctacattcgaaccctgtgtaatgtgtgcaggagcgatgatccacagtcgtattggccgcgtagtatttggtgtacgcaatgctaaaactggagccgccggatcgttgatggatgtcttgcattaccctggaatgaaccatcgtgtagagatcactgaaggcatccttgccgatgagtgtgcggctttgctttgctatttcttccgtatgccacgtcgtgtttttaacgcccaaaaaaaggctcaatccagtaccgatgggtcaggcctttctcccaagaagaagaggaaagtctaagatccggctgctaacaaagcccgaaaggaagctgagttggctgctgcggccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaattctaga

SEQ ID NO: 1426 - DNA, 8629 bp, synthetic construct
  source 1..8629: mol_type = other DNA; note = Expression of MG35-1 ABE and sgRNA with a scrabled spacer that cannot target the CAT gene
ttaattaatttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgttttttgtctcagccaatccctgggtgagtttcaccagttttgatttaaacgtggccaatatggacaacttcttcgcccccgttttcaccatgggcaaatattatacgcaaggcgacaaggtgctgatgcccctggcgattcaggtgcactacgccgtctgtgatggcttccatgtcggcagaatgcttaatgaattacaacagtactgcgatgagtggcagggcggggcgtaatttttttaaggcagttattggtgcccttaaacgcctggtgctacgcctgaataagtgaagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgactcgagtgcggccgcaagcttgtcgacggagctcgaattcggatcctaatacgactcactataggctacggctcgtccgcataagtaactgtccattaataacttagtcaactaagttattataaagttacccgcctaagttcttcgagaactacgttagggatgaaaacataggtactctcgcgatgcttctccagtccgagactctacggggaactattaaacaggtccgatggaaaggccagtgtagtttccattcaaaaccgtcctataacattggctaggagactattacccgcgtcagcggagctaggtaacaatttatgcaaagagtaaaaaaaaaccccgcttcggcggggtttttttttagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatccgaaataattttgtttaactttaagaaggagatataccccgcggatgcagcgcgttttcgtgctggaccacaacaagcagccactgatgccctgtcatccagcgcgcgcccgtaagttacttaagaaaggcaaagccgcggtgtatcgtcgttatccgtttgccatcatcatgactcatcgtgtcggcggagacctgcagactgttgagatcaagttcgccccgggcagtcgtaccacaggtattgcgctggtcggcgacttcgatcgcggtaaagaggtgatttgggccgggaatctgaatcaccgcggccaccaaattaagtcgaacctgaattcccgccgcgcgattcgtcgtgctcgtcgcaaccgcaaaacccgctaccgccaagctcgcttcaacaatcgtcgccgtccgaagggatggttaccgccgtctctgcgtagccgtgtagacaacacgaagaactggatgcacaaattggcgcgtctggcgccgcttacccagattgccgtggagaccgtgcgcttcgacacccaaaagctccagaagcctgagatctcaggcgtcgagtaccagcagggcgaactggctggatacgaattgcgcgagtatctcctggagaagtggggacgcgagtgcgcatactgcggcgctaagaacatccctctggagatcgagcatattcaggcccgcagtaagggcggctcagaccgtgtgagtaatctgacgctggcctgtacaccgtgcaacattgacaaaggaaacaaagacatcaaggaattcctgagcctgaaaccaaagcgcctgaagaagattcaggcaaccgccaccgccccgctgaaggacgccgccgcggttaacgcgacacgttatgcaaccggtaacgtactgaagtgctttagcttgccaatcacgtttagctcgggcggccgtacgaagttcaatcgcgttaaacttggttatctgaaggatcactggatcgatgccgcgtgcgttggagagtctggcagccaggtggtcatcccaaaggcaattaccccgctgatcattaccagcaaaggccgcggctctcgccaaaagtgccgcatgaaccagtatggattcccccgcacgggtccaaagaagcagaaacaagtgaaaggattccagacaggtgacatcgttaaggcgattgttaccaagggcaagaaaattggtacctacatcggccgcgtcgtagttcgttcacgcgggagtttcgacatcgggtctggagagaagaaggtcggatcaatcagctacaagtactgtcagctgttgcagcgcgccgacggatatgaatatacgtcggggagtgaaacacccggcacatccgaagcttcgacacctgaatctgcctccgaggttgaatttagtcatgaatattggatgcgccacgcgctgacgttagccaaacgtgctcgtgatgagcgcgaagttccagtcggggccgtcttggtccttaacaatcgtgtcattggcgaggggtggaaccgcgctattgggctgcacgatccaacagcgcatgctgagattatggccttgcgtcaaggagggttagtaatgcaaaactaccgtcttattgatgctacgttatactctacattcgaaccctgtgtaatgtgtgcaggagcgatgatccacagtcgtattggccgcgtagtatttggtgtacgcaatgctaaaactggagccgccggatcgttgatggatgtcttgcattaccctggaatgaaccatcgtgtagagatcactgaaggcatccttgccgatgagtgtgcggctttgctttgctatttcttccgtatgccacgtcgtgtttttaacgcccaaaaaaaggctcaatccagtaccgatgggtcaggcctttctcccaagaagaagaggaaagtctaagatccggctgctaacaaagcccgaaaggaagctgagttggctgctgcggccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaattctaga

SEQ ID NO: 1427 - RNA, 249 nt, synthetic construct
  source 1..249: mol_type = other RNA; note = MG35-1 sgRNA with spacer targeting CAT gene
gtaactgtccattaataacttagtcaactaagttattataaagttacccgcctaagttcttcgagaactacgttagggatgaaaacataggtactctcgcgatgcttctccagtccgagactctacggggaactattaaacaggtccgatggaaaggccagtgtagtttccattcaaaaccgtcctataacattggctaggagactattacccgcgtcagcggagctaggtaacaatttatgcaaagag

SEQ ID NO: 1428 - RNA, 249 nt, synthetic construct; identical to SEQ ID NO: 1427
  source 1..249: mol_type = other RNA; note = MG35-1 sgRNA with scrambled version of spacer targeting CAT gene

SEQ ID NO: 1429 - RNA, 20 nt, synthetic construct
  source 1..20: mol_type = other RNA; note = MG35-1 CAT gene target sequence
cgtagtgcacctgaatcgcc

SEQ ID NO: 1430 - RNA, 20 nt, synthetic construct
  source 1..20: mol_type = other RNA; note = MG35-1 CAT gene scrambled target sequence
gctacggctcgtccgcataa

SEQ ID NO: 1431 - RNA, 110 nt, synthetic construct
  source 1..110: mol_type = other RNA; note = MG3-6/3-8 mApoa1 BE F12
  modified_base 1: mod_base = cm
  modified_base 1^2: mod_base = OTHER; note = phosphorothioate bond
  modified_base 2: mod_base = um
  modified_base 2^3: mod_base = OTHER; note = phosphorothioate bond
  modified_base 3: mod_base = gm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
ctggtgtggtactcgttcaagggttgagaatcgaaagattcttaataaggcatccttccgatgctgacttctcaccgtccgttttccaataggagcgggcggtatgtttt

SEQ ID NO: 1432 - RNA, 110 nt, synthetic construct
  source 1..110: mol_type = other RNA; note = MG3-6/3-8 mApoa1 BE D11
  modified_base 1: mod_base = OTHER; note = 2'-O-Methyladenosine
  modified_base 1^2: mod_base = OTHER; note = phosphorothioate bond
  modified_base 2: mod_base = cm
  modified_base 2^3: mod_base = OTHER; note = phosphorothioate bond
  modified_base 3: mod_base = um
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
actatggcgcaggtcctccagcgttgagaatcgaaagattcttaataaggcatccttccgatgctgacttctcaccgtccgttttccaataggagcgggcggtatgtttt

SEQ ID NO: 1433 - RNA, 110 nt, synthetic construct
  source 1..110: mol_type = other RNA; note = MG3-6/3-8 mApoa1 BE C5
  modified_base 1: mod_base = um
  modified_base 1^2: mod_base = OTHER; note = phosphorothioate bond
  modified_base 2: mod_base = um
  modified_base 2^3: mod_base = OTHER; note = phosphorothioate bond
  modified_base 3: mod_base = gm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
ttgggtgagacaggagatgaacgttgagaatcgaaagattcttaataaggcatccttccgatgctgacttctcaccgtccgttttccaataggagcgggcggtatgtttt

SEQ ID NO: 1434 - RNA, 110 nt, synthetic construct
  source 1..110: mol_type = other RNA; note = MG3-6/3-8 mApoa1 BE A4
  modified_base 1: mod_base = um
  modified_base 1^2: mod_base = OTHER; note = phosphorothioate bond
  modified_base 2: mod_base = cm
  modified_base 2^3: mod_base = OTHER; note = phosphorothioate bond
  modified_base 3: mod_base = um
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
tctcctggaaaactgggacactgttgagaatcgaaagattcttaataaggcatccttccgatgctgacttctcaccgtccgttttccaataggagcgggcggtatgtttt

SEQ ID NO: 1435 - RNA, 110 nt, synthetic construct
  source 1..110: mol_type = other RNA; note = MG3-6/3-8 mApoa1 BE F4
  modified_base 1: mod_base = OTHER; note = 2'-O-Methyladenosine
  modified_base 1^2: mod_base = OTHER; note = phosphorothioate bond
  modified_base 2: mod_base = gm
  modified_base 2^3: mod_base = OTHER; note = phosphorothioate bond
  modified_base 3: mod_base = gm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
aggaacggctgggcccattgacgttgagaatcgaaagattcttaataaggcatccttccgatgctgacttctcaccgtccgttttccaataggagcgggcggtatgtttt

SEQ ID NO: 1436 - RNA, 110 nt, synthetic construct
  source 1..110: mol_type = other RNA; note = MG3-6/3-8 mApoa1 BE A5
  modified_base 1: mod_base = cm
  modified_base 1^2: mod_base = OTHER; note = phosphorothioate bond
  modified_base 2: mod_base = um
  modified_base 2^3: mod_base = OTHER; note = phosphorothioate bond
  modified_base 3: mod_base = gm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
ctgggataacctggagaaagaagttgagaatcgaaagattcttaataaggcatccttccgatgctgacttctcaccgtccgttttccaataggagcgggcggtatgtttt

SEQ ID NO: 1437 - RNA, 110 nt, synthetic construct
  source 1..110: mol_type = other RNA; note = MG3-6/3-8 mApoa1 BE E12
  modified_base 1: mod_base = cm
  modified_base 1^2: mod_base = OTHER; note = phosphorothioate bond
  modified_base 2: mod_base = cm
  modified_base 2^3: mod_base = OTHER; note = phosphorothioate bond
  modified_base 3: mod_base = um
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
cctggtgtggtactcgttcaaggttgagaatcgaaagattcttaataaggcatccttccgatgctgacttctcaccgtccgttttccaataggagcgggcggtatgtttt

SEQ ID NO: 1438 - RNA, 110 nt, synthetic construct
  source 1..110: mol_type = other RNA; note = MG3-6/3-8 mApoa1 BE A11
  modified_base 1: mod_base = OTHER; note = 2'-O-Methyladenosine
  modified_base 1^2: mod_base = OTHER; note = phosphorothioate bond
  modified_base 2: mod_base = gm
  modified_base 2^3: mod_base = OTHER; note = phosphorothioate bond
  modified_base 3: mod_base = cm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
agcatgggcatcagactatggcgttgagaatcgaaagattcttaataaggcatccttccgatgctgacttctcaccgtccgttttccaataggagcgggcggtatgtttt

SEQ ID NO: 1439 - RNA, 110 nt, synthetic construct
  source 1..110: mol_type = other RNA; note = MG3-6/3-8 mApoa1 BE B4
  modified_base 1: mod_base = cm
  modified_base 1^2: mod_base = OTHER; note = phosphorothioate bond
  modified_base 2: mod_base = um
  modified_base 2^3: mod_base = OTHER; note = phosphorothioate bond
  modified_base 3: mod_base = cm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
ctcctggaaaactgggacactcgttgagaatcgaaagattcttaataaggcatccttccgatgctgacttctcaccgtccgttttccaataggagcgggcggtatgtttt

SEQ ID NO: 1440 - RNA, 110 nt, synthetic construct
  source 1..110: mol_type = other RNA; note = MG3-6/3-8 mApoa1 BE G4
  modified_base 1: mod_base = gm
  modified_base 1^2: mod_base = OTHER; note = phosphorothioate bond
  modified_base 2: mod_base = gm
  modified_base 2^3: mod_base = OTHER; note = phosphorothioate bond
  modified_base 3: mod_base = OTHER; note = 2'-O-Methyladenosine
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
ggaacggctgggcccattgactgttgagaatcgaaagattcttaataaggcatccttccgatgctgacttctcaccgtccgttttccaataggagcgggcggtatgtttt

SEQ ID NO: 1441 - RNA, 110 nt, synthetic construct
  source 1..110: mol_type = other RNA; note = MG3-6/3-8 mApoa1 BE B2
  modified_base 1: mod_base = gm
  modified_base 1^2: mod_base = OTHER; note = phosphorothioate bond
  modified_base 2: mod_base = cm
  modified_base 2^3: mod_base = OTHER; note = phosphorothioate bond
  modified_base 3: mod_base = cm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
gccacaggggacagtctcccttgttgagaatcgaaagattcttaataaggcatccttccgatgctgacttctcaccgtccgttttccaataggagcgggcggtatgtttt

SEQ ID NO: 1442 - RNA, 110 nt, synthetic construct
  source 1..110: mol_type = other RNA; note = MG3-6/3-8 mApoa1 BE D7
  modified_base 1: mod_base = cm
  modified_base 1^2: mod_base = OTHER; note = phosphorothioate bond
  modified_base 2: mod_base = OTHER; note = 2'-O-Methyladenosine
  modified_base 2^3: mod_base = OTHER; note = phosphorothioate bond
  modified_base 3: mod_base = gm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
cagcgaacagatgcgcgagagcgttgagaatcgaaagattcttaataaggcatccttccgatgctgacttctcaccgtccgttttccaataggagcgggcggtatgtttt

SEQ ID NO: 1443 - RNA, 110 nt, synthetic construct
  source 1..110: mol_type = other RNA; note = MG3-6/3-8 mApoa1 BE B5
  modified_base 1: mod_base = OTHER; note = 2'-O-Methyladenosine
  modified_base 1^2: mod_base = OTHER; note = phosphorothioate bond
  modified_base 2: mod_base = um
  modified_base 2^3: mod_base = OTHER; note = phosphorothioate bond
  modified_base 3: mod_base = um
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
attgggtgagacaggagatgaagttgagaatcgaaagattcttaataaggcatccttccgatgctgacttctcaccgtccgttttccaataggagcgggcggtatgtttt

SEQ ID NO: 1444 - RNA, 110 nt, synthetic construct
  source 1..110: mol_type = other RNA; note = MG3-6/3-8 mApoa1 BE G6
  modified_base 1: mod_base = OTHER; note = 2'-O-Methyladenosine
  modified_base 1^2: mod_base = OTHER; note = phosphorothioate bond
  modified_base 2: mod_base = gm
  modified_base 2^3: mod_base = OTHER; note = phosphorothioate bond
  modified_base 3: mod_base = gm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
agggagactgtcccctgtggctgttgagaatcgaaagattcttaataaggcatccttccgatgctgacttctcaccgtccgttttccaataggagcgggcggtatgtttt

SEQ ID NO: 1445 - RNA, 110 nt, synthetic construct
  source 1..110: mol_type = other RNA; note = MG3-6/3-8 mApoa1 BE A8
  modified_base 1: mod_base = cm
  modified_base 1^2: mod_base = OTHER; note = phosphorothioate bond
  modified_base 2: mod_base = cm
  modified_base 2^3: mod_base = OTHER; note = phosphorothioate bond
  modified_base 3: mod_base = um
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
cctaccttgaacgagtaccacagttgagaatcgaaagattcttaataaggcatccttccgatgctgacttctcaccgtccgttttccaataggagcgggcggtatgtttt

SEQ ID NO: 1446 - RNA, 110 nt, synthetic construct
  source 1..110: mol_type = other RNA; note = MG3-6/3-8 mApoa1 BE F2
  modified_base 1: mod_base = gm
  modified_base 1^2: mod_base = OTHER; note = phosphorothioate bond
  modified_base 2: mod_base = gm
  modified_base 2^3: mod_base = OTHER; note = phosphorothioate bond
  modified_base 3: mod_base = cm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
ggcccaaggaggaggattcaaagttgagaatcgaaagattcttaataaggcatccttccgatgctgacttctcaccgtccgttttccaataggagcgggcggtatgtttt

SEQ ID NO: 1447 - RNA, 110 nt, synthetic construct
  source 1..110: mol_type = other RNA; note = MG3-6/3-8 mApoa1 BE E1
  modified_base 1: mod_base = OTHER; note = 2'-O-Methyladenosine
  modified_base 1^2: mod_base = OTHER; note = phosphorothioate bond
  modified_base 2: mod_base = gm
  modified_base 2^3: mod_base = OTHER; note = phosphorothioate bond
  modified_base 3: mod_base = cm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
agcaagatgaaccccagtcccagttgagaatcgaaagattcttaataaggcatccttccgatgctgacttctcaccgtccgttttccaataggagcgggcggtatgtttt

SEQ ID NO: 1448 - RNA, 110 nt, synthetic construct
  source 1..110: mol_type = other RNA; note = MG3-6/3-8 mApoa1 BE B8
  modified_base 1: mod_base = cm
  modified_base 1^2: mod_base = OTHER; note = phosphorothioate bond
  modified_base 2: mod_base = um
  modified_base 2^3: mod_base = OTHER; note = phosphorothioate bond
  modified_base 3: mod_base = OTHER; note = 2'-O-Methyladenosine
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
ctaccttgaacgagtaccacacgttgagaatcgaaagattcttaataaggcatccttccgatgctgacttctcaccgtccgttttccaataggagcgggcggtatgtttt

SEQ ID NO: 1449 - RNA, 110 nt, synthetic construct
  source 1..110: mol_type = other RNA; note = MG3-6/3-8 mApoa1 BE H8
  modified_base 1: mod_base = cm
  modified_base 1^2: mod_base = OTHER; note = phosphorothioate bond
  modified_base 2: mod_base = OTHER; note = 2'-O-Methyladenosine
  modified_base 2^3: mod_base = OTHER; note = phosphorothioate bond
  modified_base 3: mod_base = um
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
catgctggagacgcttaagaccgttgagaatcgaaagattcttaataaggcatccttccgatgctgacttctcaccgtccgttttccaataggagcgggcggtatgtttt

SEQ ID NO: 1450 - RNA, 110 nt, synthetic construct
  source 1..110: mol_type = other RNA; note = MG3-6/3-8 mApoa1 BE H6
  modified_base 1: mod_base = um
  modified_base 1^2: mod_base = OTHER; note = phosphorothioate bond
  modified_base 2: mod_base = cm
  modified_base 2^3: mod_base = OTHER; note = phosphorothioate bond
  modified_base 3: mod_base = gm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
tcgcgaccgcatgcgcacacacgttgagaatcgaaagattcttaataaggcatccttccgatgctgacttctcaccgtccgttttccaataggagcgggcggtatgtttt

SEQ ID NO: 1451 - RNA, 110 nt, synthetic construct
  source 1..110: mol_type = other RNA; note = MG3-6/3-8 mApoa1 BE F5
  modified_base 1: mod_base = OTHER; note = 2'-O-Methyladenosine
  modified_base 1^2: mod_base = OTHER; note = phosphorothioate bond
  modified_base 2: mod_base = cm
  modified_base 2^3: mod_base = OTHER; note = phosphorothioate bond
  modified_base 3: mod_base = gm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
acgaattccagaagaaatggaagttgagaatcgaaagattcttaataaggcatccttccgatgctgacttctcaccgtccgttttccaataggagcgggcggtatgtttt

SEQ ID NO: 1452 - RNA, 110 nt, synthetic construct
  source 1..110: mol_type = other RNA; note = MG3-6/3-8 mApoa1 BE H3
  modified_base 1: mod_base = cm
  modified_base 1^2: mod_base = OTHER; note = phosphorothioate bond
  modified_base 2: mod_base = um
  modified_base 2^3: mod_base = OTHER; note = phosphorothioate bond
  modified_base 3: mod_base = OTHER; note = 2'-O-Methyladenosine
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
ctagcctgaatctcctggaaaagttgagaatcgaaagattcttaataaggcatccttccgatgctgacttctcaccgtccgttttccaataggagcgggcggtatgtttt

SEQ ID NO: 1453 - RNA, 110 nt, synthetic construct
  source 1..110: mol_type = other RNA; note = MG3-6/3-8 mApoa1 BE H4
  modified_base 1: mod_base = um
  modified_base 1^2: mod_base = OTHER; note = phosphorothioate bond
  modified_base 2: mod_base = gm
  modified_base 2^3: mod_base = OTHER; note = phosphorothioate bond
  modified_base 3: mod_base = gm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
tgggcccattgactcgggacttgttgagaatcgaaagattcttaataaggcatccttccgatgctgacttctcaccgtccgttttccaataggagcgggcggtatgtttt

SEQ ID NO: 1454 - RNA, 110 nt, synthetic construct
  source 1..110: mol_type = other RNA; note = MG3-6/3-8 mApoa1 BE E8
  modified_base 1: mod_base = cm
  modified_base 1^2: mod_base = OTHER; note = phosphorothioate bond
  modified_base 2: mod_base = gm
  modified_base 2^3: mod_base = OTHER; note = phosphorothioate bond
  modified_base 3: mod_base = OTHER; note = 2'-O-Methyladenosine
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
cgagaaagccagacctgcgctggttgagaatcgaaagattcttaataaggcatccttccgatgctgacttctcaccgtccgttttccaataggagcgggcggtatgtttt

SEQ ID NO: 1455 - DNA, 22 bp, synthetic construct
  source 1..22: mol_type = other DNA; note = MG3-6/3-8 mApoa1 BE F12
ctggtgtggtactcgttcaagg

SEQ ID NO: 1456 - DNA, 22 bp, synthetic construct
  source 1..22: mol_type = other DNA; note = MG3-6/3-8 mApoa1 BE D11
actatggcgcaggtcctccagc

SEQ ID NO: 1457 - DNA, 22 bp, synthetic construct
  source 1..22: mol_type = other DNA; note = MG3-6/3-8 mApoa1 BE C5
ttgggtgagacaggagatgaac

SEQ ID NO: 1458 - DNA, 22 bp, synthetic construct
  source 1..22: mol_type = other DNA; note = MG3-6/3-8 mApoa1 BE A4
tctcctggaaaactgggacact

SEQ ID NO: 1459 - DNA, 22 bp, synthetic construct
  source 1..22: mol_type = other DNA; note = MG3-6/3-8 mApoa1 BE F4
aggaacggctgggcccattgac

SEQ ID NO: 1460 - DNA, 22 bp, synthetic construct
  source 1..22: mol_type = other DNA; note = MG3-6/3-8 mApoa1 BE A5
ctgggataacctggagaaagaa

SEQ ID NO: 1461 - DNA, 22 bp, synthetic construct
  source 1..22: mol_type = other DNA; note = MG3-6/3-8 mApoa1 BE E12
cctggtgtggtactcgttcaag

SEQ ID NO: 1462 - DNA, 22 bp, synthetic construct
  source 1..22: mol_type = other DNA; note = MG3-6/3-8 mApoa1 BE A11
agcatgggcatcagactatggc

SEQ ID NO: 1463 - DNA, 22 bp, synthetic construct
  source 1..22: mol_type = other DNA; note = MG3-6/3-8 mApoa1 BE B4
ctcctggaaaactgggacactc

SEQ ID NO: 1464 - DNA, 22 bp, synthetic construct
  source 1..22: mol_type = other DNA; note = MG3-6/3-8 mApoa1 BE G4
ggaacggctgggcccattgact

SEQ ID NO: 1465 - DNA, 22 bp, synthetic construct
  source 1..22: mol_type = other DNA; note = MG3-6/3-8 mApoa1 BE B2
gccacaggggacagtctccctt

SEQ ID NO: 1466 - DNA, 22 bp, synthetic construct
  source 1..22: mol_type = other DNA; note = MG3-6/3-8 mApoa1 BE D7
cagcgaacagatgcgcgagagc

SEQ ID NO: 1467 - DNA, 22 bp, synthetic construct
  source 1..22: mol_type = other DNA; note = MG3-6/3-8 mApoa1 BE B5
attgggtgagacaggagatgaa

SEQ ID NO: 1468 - DNA, 22 bp, synthetic construct
  source 1..22: mol_type = other DNA; note = MG3-6/3-8 mApoa1 BE G6
agggagactgtcccctgtggct

SEQ ID NO: 1469 - DNA, 22 bp, synthetic construct
  source 1..22: mol_type = other DNA; note = MG3-6/3-8 mApoa1 BE A8
cctaccttgaacgagtaccaca

SEQ ID NO: 1470 - DNA, 22 bp, synthetic construct
  source 1..22: mol_type = other DNA; note = MG3-6/3-8 mApoa1 BE F2
ggcccaaggaggaggattcaaa

SEQ ID NO: 1471 - DNA, 22 bp, synthetic construct
  source 1..22: mol_type = other DNA; note = MG3-6/3-8 mApoa1 BE E1
agcaagatgaaccccagtccca

SEQ ID NO: 1472 - DNA, 22 bp, synthetic construct
  source 1..22: mol_type = other DNA; note = MG3-6/3-8 mApoa1 BE B8
ctaccttgaacgagtaccacac

SEQ ID NO: 1473 - DNA, 22 bp, synthetic construct
  source 1..22: mol_type = other DNA; note = MG3-6/3-8 mApoa1 BE H8
catgctggagacgcttaagacc

SEQ ID NO: 1474 - DNA, 22 bp, synthetic construct
  source 1..22: mol_type = other DNA; note = MG3-6/3-8 mApoa1 BE H6
tcgcgaccgcatgcgcacacac

SEQ ID NO: 1475 - DNA, 22 bp, synthetic construct
  source 1..22: mol_type = other DNA; note = MG3-6/3-8 mApoa1 BE F5
acgaattccagaagaaatggaa

SEQ ID NO: 1476 - DNA, 22 bp, synthetic construct
  source 1..22: mol_type = other DNA; note = MG3-6/3-8 mApoa1 BE H3
ctagcctgaatctcctggaaaa

SEQ ID NO: 1477 - DNA, 22 bp, synthetic construct
  source 1..22: mol_type = other DNA; note = MG3-6/3-8 mApoa1 BE H4
tgggcccattgactcgggactt

SEQ ID NO: 1478 - DNA, 22 bp, synthetic construct
  source 1..22: mol_type = other DNA; note = MG3-6/3-8 mApoa1 BE E8
cgagaaagccagacctgcgctg

SEQ ID NO: 1479 - RNA, 110 nt, synthetic construct
  source 1..110: mol_type = other RNA; note = MG3-6/3-8 mAngptl3 BE C12
  modified_base 1: mod_base = OTHER; note = 2'-O-Methyladenosine
  modified_base 1^2: mod_base = OTHER; note = phosphorothioate bond
  modified_base 2: mod_base = cm
  modified_base 2^3: mod_base = OTHER; note = phosphorothioate bond
  modified_base 3: mod_base = um
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
actattaaaccaagaaactcccgttgagaatcgaaagattcttaataaggcatccttccgatgctgacttctcaccgtccgttttccaataggagcgggcggtatgtttt

SEQ ID NO: 1480 - RNA, 110 nt, synthetic construct
  source 1..110: mol_type = other RNA; note = MG3-6/3-8 mAngptl3 BE B2
  modified_base 1: mod_base = cm
  modified_base 1^2: mod_base = OTHER; note = phosphorothioate bond
  modified_base 2: mod_base = gm
  modified_base 2^3: mod_base = OTHER; note = phosphorothioate bond
  modified_base 3: mod_base = OTHER; note = 2'-O-Methyladenosine
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
cgaaacatgggaaaactacgaagttgagaatcgaaagattcttaataaggcatccttccgatgctgacttctcaccgtccgttttccaataggagcgggcggtatgtttt

SEQ ID NO: 1481 - RNA, 110 nt, synthetic construct
  source 1..110: mol_type = other RNA; note = MG3-6/3-8 mAngptl3 BE C1
  modified_base 1: mod_base = OTHER; note = 2'-O-Methyladenosine
  modified_base 1^2: mod_base = OTHER; note = phosphorothioate bond
  modified_base 2: mod_base = gm
  modified_base 2^3: mod_base = OTHER; note = phosphorothioate bond
  modified_base 3: mod_base = um
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
agtaattgcatccagagtggatgttgagaatcgaaagattcttaataaggcatccttccgatgctgacttctcaccgtccgttttccaataggagcgggcggtatgtttt

SEQ ID NO: 1482 - RNA, 110 nt, synthetic construct
  source 1..110: mol_type = other RNA; note = MG3-6/3-8 mAngptl3 BE F3
  modified_base 1: mod_base = OTHER; note = 2'-O-Methyladenosine
  modified_base 1^2: mod_base = OTHER; note = phosphorothioate bond
  modified_base 2: mod_base = OTHER; note = 2'-O-Methyladenosine
  modified_base 2^3: mod_base = OTHER; note = phosphorothioate bond
  modified_base 3: mod_base = gm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
aagagaagacagcccttcaacagttgagaatcgaaagattcttaataaggcatccttccgatgctgacttctcaccgtccgttttccaataggagcgggcggtatgtttt

SEQ ID NO: 1483 - RNA, 110 nt, synthetic construct
  source 1..110: mol_type = other RNA; note = MG3-6/3-8 mAngptl3 BE G1
  modified_base 1: mod_base = um
  modified_base 1^2: mod_base = OTHER; note = phosphorothioate bond
  modified_base 2: mod_base = um
  modified_base 2^3: mod_base = OTHER; note = phosphorothioate bond
  modified_base 3: mod_base = um
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
tttagcgaatggcctcctgcaggttgagaatcgaaagattcttaataaggcatccttccgatgctgacttctcaccgtccgttttccaataggagcgggcggtatgtttt

SEQ ID NO: 1484 - DNA, 22 bp, synthetic construct
  source 1..22: mol_type = other DNA; note = MG3-6/3-8 mAngptl3 BE C12
actattaaaccaagaaactccc

SEQ ID NO: 1485 - DNA, 22 bp, synthetic construct
  source 1..22: mol_type = other DNA; note = MG3-6/3-8 mAngptl3 BE B2
cgaaacatgggaaaactacgaa

SEQ ID NO: 1486 - DNA, 22 bp, synthetic construct
  source 1..22: mol_type = other DNA; note = MG3-6/3-8 mAngptl3 BE C1
agtaattgcatccagagtggat

SEQ ID NO: 1487 - DNA, 22 bp, synthetic construct
  source 1..22: mol_type = other DNA; note = MG3-6/3-8 mAngptl3 BE F3
aagagaagacagcccttcaaca

SEQ ID NO: 1488 - DNA, 22 bp, synthetic construct
  source 1..22: mol_type = other DNA; note = MG3-6/3-8 mAngptl3 BE G1
tttagcgaatggcctcctgcag

SEQ ID NO: 1489 - RNA, 110 nt, synthetic construct
  source 1..110: mol_type = other RNA; note = MG3-6/3-8 mTrac BE E1
  modified_base 1: mod_base = OTHER; note = 2'-O-Methyladenosine
  modified_base 1^2: mod_base = OTHER; note = phosphorothioate bond
  modified_base 2: mod_base = cm
  modified_base 2^3: mod_base = OTHER; note = phosphorothioate bond
  modified_base 3: mod_base = cm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
accagttaaaagatcctcggtcgttgagaatcgaaagattcttaataaggcatccttccgatgctgacttctcaccgtccgttttccaataggagcgggcggtatgtttt

SEQ ID NO: 1490 - RNA, 110 nt, synthetic construct
  source 1..110: mol_type = other RNA; note = MG3-6/3-8 mTrac BE D10
  modified_base 1: mod_base = um
  modified_base 1^2: mod_base = OTHER; note = phosphorothioate bond
  modified_base 2: mod_base = um
  modified_base 2^3: mod_base = OTHER; note = phosphorothioate bond
  modified_base 3: mod_base = cm
  modified_base 3^4: mod_base = OTHER; note = phosphorothioate bond
  modified_base 107^108: mod_base = OTHER; note = phosphorothioate bond
  modified_base 108: mod_base = um
  modified_base 108^109: mod_base = OTHER; note = phosphorothioate bond
  modified_base 109: mod_base = um
  modified_base 109^110: mod_base = OTHER; note = phosphorothioate bond
  modified_base 110: mod_base = um
ttcacaatcccacctggatctcgttgagaatcgaaagattcttaataaggcatccttccgatgctgacttctcaccgtccgttttccaataggagcgggcggtatgtttt

SEQ ID NO: 1491 - DNA, 22 bp, synthetic construct
  source 1..22: mol_type = other DNA; note = MG3-6/3-8 mTrac BE E1
accagttaaaagatcctcggtc

SEQ ID NO: 1492 - DNA, 22 bp, synthetic construct
  source 1..22: mol_type = other DNA; note = MG3-6/3-8 mTrac BE D10
ttcacaatcccacctggatctc

SEQ ID NO: 1493 - DNA, 38 bp, synthetic construct
  source 1..38: mol_type = other DNA; note = mApoa1 BE F12F
gctcttccgatctnnnnntgcgcacacacgtagactct

SEQ ID NO: 1494 - DNA, 38 bp, synthetic construct
  source 1..38: mol_type = other DNA; note = mApoa1 BE D11F
gctcttccgatctnnnnntgagctcaagagcaacccta

SEQ ID NO: 1495 - DNA, 38 bp, synthetic construct
  source 1..38: mol_type = other DNA; note = mApoa1 BE C5F
gctcttccgatctnnnnntctagcctgaatctcctgga

SEQ ID NO: 1496 - DNA, 38 bp, synthetic construct
  source 1..38: mol_type = other DNA; note = mApoa1 BE A4F
gctcttccgatctnnnnncaactgcacattaggggaca

SEQ ID NO: 1497 - DNA, 38 bp, synthetic construct
  source 1..38: mol_type = other DNA; note = mApoa1 BE F4F
gctcttccgatctnnnnntcatgtgcatggatctgcag

SEQ ID NO: 1498 - DNA, 38 bp, synthetic construct; identical to SEQ ID NO: 1495
  source 1..38: mol_type = other DNA; note = mApoa1 BE A5F

SEQ ID NO: 1499 - DNA, 38 bp, synthetic construct; identical to SEQ ID NO: 1493
  source 1..38: mol_type = other DNA; note = mApoa1 BE E12F

SEQ ID NO: 1500 - DNA, 38 bp, synthetic construct; identical to SEQ ID NO: 1494
  source 1..38: mol_type = other DNA; note = mApoa1 BE A11F

SEQ ID NO: 1501 - DNA, 38 bp, synthetic construct; identical to SEQ ID NO: 1496
  source 1..38: mol_type = other DNA; note = mApoa1 BE B4F

SEQ ID NO: 1502 - DNA, 38 bp, synthetic construct; identical to SEQ ID NO: 1497
  source 1..38: mol_type = other DNA; note = mApoa1 BE G4F

SEQ ID NO: 1503 - DNA, 38 bp, synthetic construct
  source 1..38: mol_type = other DNA; note = mApoa1 BE B2F
gctcttccgatctnnnnnatggaaagaggatgtggagc

SEQ ID NO: 1504 - DNA, 38 bp, synthetic construct
  source 1..38: mol_type = other DNA; note = mApoa1 BE D7F
gctcttccgatctnnnnnagaagctgcaggagctgcaa

SEQ ID NO: 1505 - DNA, 38 bp, synthetic construct; identical to SEQ ID NO: 1495
  source 1..38: mol_type = other DNA; note = mApoa1 BE B5F

SEQ ID NO: 1506 - DNA, 38 bp, synthetic construct
  source 1..38: mol_type = other DNA; note = mApoa1 BE G6F
gctcttccgatctnnnnnaagaggatgtggagctctac

SEQ ID NO: 1507 - DNA, 38 bp, synthetic construct; identical to SEQ ID NO: 1493
  source 1..38: mol_type = other DNA; note = mApoa1 BE A8F

SEQ ID NO: 1508 - DNA, 38 bp, synthetic construct
  source 1..38: mol_type = other DNA; note = mApoa1 BE F2F
gctcttccgatctnnnnncacgtatggcagcaagatga

SEQ ID NO: 1509 - DNA, 38 bp, synthetic construct
  source 1..38: mol_type = other DNA; note = mApoa1 BE E1F
gctcttccgatctnnnnngcacagagaacagaattccc

SEQ ID NO: 1510 - DNA, 38 bp, synthetic construct; identical to SEQ ID NO: 1493
  source 1..38: mol_type = other DNA; note = mApoa1 BE B8F

SEQ ID NO: 1511 - DNA, 38 bp, synthetic construct
  source 1..38: mol_type = other DNA; note = mApoa1 BE H8F
gctcttccgatctnnnnnttgaacgagtaccacaccag

SEQ ID NO: 1512 - DNA, 38 bp, synthetic construct; identical to SEQ ID NO: 1506
  source 1..38: mol_type = other DNA; note = mApoa1 BE H6F

SEQ ID NO: 1513 - DNA, 38 bp, synthetic construct
  source 1..38: mol_type = other DNA; note = mApoa1 BE F5F
gctcttccgatctnnnnnggacttctgggataacctgg

SEQ ID NO: 1514 - DNA, 38 bp, synthetic construct; identical to SEQ ID NO: 1496
  source 1..38: mol_type = other DNA; note = mApoa1 BE H3F

SEQ ID NO: 1515 - DNA, 38 bp, synthetic construct; identical to SEQ ID NO: 1495
  source 1..38: mol_type = other DNA; note = mApoa1 BE H4F

SEQ ID NO: 1516 - DNA, 38 bp, synthetic construct; identical to SEQ ID NO: 1494
  source 1..38: mol_type = other DNA; note = mApoa1 BE E8F

SEQ ID NO: 1517 - DNA, 39 bp, synthetic construct
  source 1..39: mol_type = other DNA; note = mAngptl3 BE C12F
gctcttccgatctnnnnnctgtcaattctagaccttcct

SEQ ID NO: 1518 - DNA, 38 bp, synthetic construct
  source 1..38: mol_type = other DNA; note = mAngptl3 BE B2F
gctcttccgatctnnnnngggtgatttttcctccgtca

SEQ ID NO: 1519 - DNA, 38 bp, synthetic construct
  source 1..38: mol_type = other DNA; note = mAngptl3 BE C1F
gctcttccgatctnnnnnaagtcaagaggtccaggtct

SEQ ID NO: 1520 - DNA, 39 bp, synthetic construct
  source 1..39: mol_type = other DNA; note = mAngptl3 BE F3F
gctcttccgatctnnnnncaaagaagaggaaaaggagct

SEQ ID NO: 1521 - DNA, 38 bp, synthetic construct
  source 1..38: mol_type = other DNA; note = mAngptl3 BE G1F
gctcttccgatctnnnnnccagagtggatccagacctt

SEQ ID NO: 1522 - DNA, 38 bp, synthetic construct
  source 1..38: mol_type = other DNA; note = mTrac BE E1F
gctcttccgatctnnnnnggcatctgagttctgaccta

SEQ ID NO: 1523 - DNA, 38 bp, synthetic construct
  source 1..38: mol_type = other DNA; note = mTrac BE D10F
gctcttccgatctnnnnnaggtctgcaagactgacaga

SEQ ID NO: 1524 - DNA, 38 bp, synthetic construct
  source 1..38: mol_type = other DNA; note = mApoa1 BE F12R
gctcttccgatctnnnnnctggccttgtcgatcacact

SEQ ID NO: 1525 - DNA, 38 bp, synthetic construct
  source 1..38: mol_type = other DNA; note = mApoa1 BE D11R
gctcttccgatctnnnnntgtaagaaagccaatgcggg

SEQ ID NO: 1526 - DNA, 38 bp, synthetic construct
  source 1..38: mol_type = other DNA; note = mApoa1 BE C5R
gctcttccgatctnnnnngtagagctccacatcctctt

SEQ ID NO: 1527 - DNA, 38 bp, synthetic construct
  source 1..38: mol_type = other DNA; note = mApoa1 BE A4R
gctcttccgatctnnnnnccttgttcatctcctgtctc

SEQ ID NO: 1528 - DNA, 38 bp, synthetic construct
  source 1..38: mol_type = other DNA; note = mApoa1 BE F4R
gctcttccgatctnnnnntagggctgcaccttctgttt

SEQ ID NO: 1529 - DNA, 38 bp, synthetic construct; identical to SEQ ID NO: 1526
  source 1..38: mol_type = other DNA; note = mApoa1 BE A5R

SEQ ID NO: 1530 - DNA, 38 bp, synthetic construct; identical to SEQ ID NO: 1524
  source 1..38: mol_type = other DNA; note = mApoa1 BE E12R

SEQ ID NO: 1531 - DNA, 38 bp, synthetic construct; identical to SEQ ID NO: 1525
  source 1..38: mol_type = other DNA; note = mApoa1 BE A11R

SEQ ID NO: 1532 - DNA, 38 bp, synthetic construct; identical to SEQ ID NO: 1527
  source 1..38: mol_type = other DNA; note = mApoa1 BE B4R

SEQ ID NO: 1533 - DNA, 38 bp, synthetic construct; identical to SEQ ID NO: 1528
  source 1..38: mol_type = other DNA; note = mApoa1 BE G4R

SEQ ID NO: 1534 - DNA, 38 bp, synthetic construct
  source 1..38: mol_type = other DNA; note = mApoa1 BE B2R
gctcttccgatctnnnnngttcaaggtagggttgctct

SEQ ID NO: 1535 - DNA, 38 bp, synthetic construct
  source 1..38: mol_type = other DNA; note = mApoa1 BE D7R
gctcttccgatctnnnnnatcagactatggcgcaggtc

SEQ ID NO: 1536 - DNA, 38 bp, synthetic construct; identical to SEQ ID NO: 1526
  source 1..38: mol_type = other DNA; note = mApoa1 BE B5R

SEQ ID NO: 1537 - DNA, 38 bp, synthetic construct
  source 1..38: mol_type = other DNA; note = mApoa1 BE G6R
gctcttccgatctnnnnngtgtggtactcgttcaaggt

SEQ ID NO: 1538 - DNA, 38 bp, synthetic construct; identical to SEQ ID NO: 1524
  source 1..38: mol_type = other DNA; note = mApoa1 BE A8R

SEQ ID NO: 1539 - DNA, 38 bp, synthetic construct
  source 1..38: mol_type = other DNA; note = mApoa1 BE F2R
gctcttccgatctnnnnncagctcagttccagcatctt

SEQ ID NO: 1540 - DNA, 38 bp, synthetic construct
  source 1..38: mol_type = other DNA; note = mApoa1 BE E1R
gctcttccgatctnnnnncacgctaggtctttccttac

SEQ ID NO: 1541 - DNA, 38 bp, synthetic construct; identical to SEQ ID NO: 1524
  source 1..38: mol_type = other DNA; note = mApoa1 BE B8R

SEQ ID NO: 1542 - DNA, 38 bp, synthetic construct
  source 1..38: mol_type = other DNA; note = mApoa1 BE H8R
gctcttccgatctnnnnngtcccccaaagaaagaagct

SEQ ID NO: 1543 - DNA, 38 bp, synthetic construct; identical to SEQ ID NO: 1537
  source 1..38: mol_type = other DNA; note = mApoa1 BE H6R

SEQ ID NO: 1544 - DNA, 38 bp, synthetic construct
  source 1..38: mol_type = other DNA; note = mApoa1 BE F5R
gctcttccgatctnnnnncatgcggtcgcgaaattcct

SEQ ID NO: 1545 - DNA, 38 bp, synthetic construct; identical to SEQ ID NO: 1527
  source 1..38: mol_type = other DNA; note = mApoa1 BE H3R

SEQ ID NO: 1546 - DNA, 38 bp, synthetic construct; identical to SEQ ID NO: 1526
  source 1..38: mol_type = other DNA; note = mApoa1 BE H4R

SEQ ID NO: 1547 - DNA, 38 bp, synthetic construct; identical to SEQ ID NO: 1525
  source 1..38: mol_type = other DNA; note = mApoa1 BE E8R

SEQ ID NO: 1548 - DNA, 39 bp, synthetic construct
  source 1..39: mol_type = other DNA; note = mAngptl3 BE C12R
gctcttccgatctnnnnntctgtgagttgataacaggct

SEQ ID NO: 1549 - DNA, 38 bp, synthetic construct
  source 1..38: mol_type = other DNA; note = mAngptl3 BE B2R
gctcttccgatctnnnnnaacccctaaagggctgtgat

SEQ ID NO: 1550 - DNA, 38 bp, synthetic construct
  source 1..38: mol_type = other DNA; note = mAngptl3 BE C1R
gctcttccgatctnnnnnctttaagtccatgacccagc

SEQ ID NO: 1551 - DNA, 39 bp, synthetic construct
  source 1..39: mol_type = other DNA; note = mAngptl3 BE F3R
gctcttccgatctnnnnncagagtgctgtgatttctact

SEQ ID NO: 1552 - DNA, 39 bp, synthetic construct
  source 1..39: mol_type = other DNA; note = mAngptl3 BE G1R
gctcttccgatctnnnnncttagctccttttcctcttct

SEQ ID NO: 1553 - DNA, 38 bp, synthetic construct
  source 1..38: mol_type = other DNA; note = mTrac BE E1R
gctcttccgatctnnnnncccattgctcttggaatcca

SEQ ID NO: 1554 - DNA, 38 bp, synthetic construct
  source 1..38: mol_type = other DNA; note = mTrac BE D10R
gctcttccgatctnnnnncccctgccgttttttgtgaa

SEQ ID NO: 1555 - DNA, 2803 bp, synthetic construct
  source 1..2803: mol_type = other DNA; note = mRNA production
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagagcaagtcccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatcccttgaagactaaaaaaaa

SEQ ID NO: 1556 - protein, 156 aa, unidentified
  source 1..156: note = mutated adenine deaminase_MG131-1v1
MDADDERWMRIALDEADSARAKGEVPVGCAIVSLTGELLASGHNLAETLEDPTAHAEIVAMRIAARKLDTWRLESTTLYSTFEPCVMCAGAMVNARVGRVVYGVLNSKTGAVTTLFNIGNYTRLNHRFPVTGGVLADDCAERLCRFYSAPRAVFNK

SEQ ID NO: 1557 - protein, 148 aa, unidentified
  source 1..148: note = mutated adenine deaminase_MG131-2v2
MRAALAEADAARAIGEVPVGCVLVGLDGAELARGHNLAEALQDPTAHAEMIAVRAAAAKIGSFRLEGVTAYSTFEPCPMCAGALVHARVAHVVYGVDNSKTGAVTSLYNVGNYGKMNHTFTLTRGVLADESAARLCTFYAGPRAVFNK

SEQ ID NO: 1558 - protein, 156 aa, unidentified
  source 1..156: note = mutated adenine deaminase_MG131-5v3
MDVTQDVAFMLEALAEADRAREIGEVPVGAVMVLGNAIVARGHNLAESLADPTAHAEMIAIRECAKTRGDWRLDDATLYSTFEPCPMCAGALVHARVKRVVYGVDNSKTGAVKTLFNIGNYPRLNHRFELTSGVRAEECASKLCAFYQRPRAVFNK

SEQ ID NO: 1559 - protein, 175 aa, unidentified
  source 1..175: note = mutated adenine deaminase_MG131-6v4
MSTAASFPLPAESAEPPATPALTVAPEHVAYMRQALEAAEAARQRGEVPVGAVVVLGGAVIAVAHNEAETLNDPTAHAEVLALRRAAAALGSWRLTEADLYSTFEPCPMCAGAIVNARVRRVYYGVDNSKTGAVRSLYNILNYRRLNHRVEVVPGVLSVEAAGLLCAFYGRPRRV

SEQ ID NO: 1560 - protein, 168 aa, unidentified
  source 1..168: note = mutated adenine deaminase_MG131-9v5
MSVTRTAELPLDATPEAVAVDELHMRTALAAAERARLSGEVPVGAVVVLRGEVIAVAHNQAETLNDPTAHAEIVALRAAAAALNSWRLVDADLYSTFEPCPMCAGAIVNARVRRVIYGVDNSKTGAVRTLFNLLNYQRLNHRVEVVSGVLAAESSALLCSFYSRPRLV

SEQ ID NO: 1561 - protein, 178 aa, unidentified
  source 1..178: note = mutated adenine deaminase_MG131-7v6
MTTAAAAEPLSSSTLAEGGSSVGERELSFMRRALAAAELARGRGEVPVGAVVVLGDEVVAIAHNEAETLGDPTAHAEILALRRAAAALGRWRLTDADLYSTFEPCPMCAQAISFARLRRLYFGVDNSKTGAVRTLYNLVNYSRLNHRVEVFPNVLAAEGAALLCGFYSRPRQVFNRER

SEQ ID NO: 1562 - protein, 162 aa, unidentified
  source 1..162: note = mutated adenine deaminase_MG131-3v7
MKKDRVFMAEAMALADRARELGEIPVGAVIVLKGRVIARAFNRAEALQDPTAHAELIAIRRAAEALGEWRLSECTLFSTFEPCPMCAGTIVNSRVGRVVYGVPNSKTGAVRSVYNMLNYPRLNHRCAVARTMAAECSEQLCAFYVAPREVFNAQKKAQSSIN

SEQ ID NO: 1563 - protein, 166 aa, unidentified
  source 1..166: note = mutated adenine deaminase_MG134-1v1
MLTSDQEYMNLALELGLQARREGDIPVGALVVLPCGEIIGRGRNRARILHDPTAHAEVVALREAARNLGVWNLNGCSLYSTFEPCPMCAGALVQARVSRLVYGVTNSKRGACGTLYNLTNYTRLFHRLQVVPGVMEQECRALLCDFYRECREVFNTFGRLLDGRNN

SEQ ID NO: 1564 - protein, 158 aa, unidentified
  source 1..158: note = mutated adenine deaminase_MG134-2v2
MTDDERFMGYALARAEAARARGDVPVGAVVVLDGAVVGVGENRAEILADPTGHAEIVALRDACRSAGRWRIDGATLYSTFEPCPMCAGAIVNARVARLVYGVDNSKRGAVRSLYNICNYPRLNHRVELCPGVLAEPAAGLLCDFYRRARAVFNLGQGV

SEQ ID NO: 1565 - protein, 166 aa, unidentified
  source 1..166: note = mutated adenine deaminase_MG134-3v3
MGDSDPTAADLSFMDAALDLARRARDAGDVPVGALVVLDGRIVGIGGNRAEVLADPSGHAEIVALRDAGKSVGRWRVDGATLYSTFEPCPMCAGAIVSARVARLVYGVDNSKRGAVRTLYNICNYPRLNHRVEVVAGVRAEESRALLCDFYAQARQVFNPRPGGAR

SEQ ID NO: 1566 - protein, 177 aa, unidentified
  source 1..177: note = mutated adenine deaminase_MG134-4v4
MAADLEYMRLALELAAEARERGDVPVGALVVLEGRILGTGFNTAERLHDPTGHAEVVAMREACRQARRWRLDGATLYSTFEPCPMCAGALINTRIARLVYGVHNSKRGAVRSLYNLCNYPRLNHRIEVVGGILAEDGAAQLCQFYRAPRAVFNRERAAGNEAPRWERGEQERRGDQE

SEQ ID NO: 1567 - protein, 156 aa, unidentified
  source 1..156: note = mutated adenine deaminase_MG135-1v1
MSHSDELFMEEALREAQRARALGEVPVGAVVVLDGHIVGRGCNRAVTLHDPTAHAEIQALREAGHVVGNYRLNDCDLYSTFEPCAMCAGAITHARIRRLIYGVENSKTGAVHSMLNVLNYPKLNHQVEVTCGVLAARCMDLLCTFYRTPRTTAENH

SEQ ID NO: 1568 - protein, 169 aa, unidentified
  source 1..169: note = mutated adenine deaminase_MG135v-2v2
MLIASHCISLFAMSLSDEFWMEEALREAQRARALGEVPVGAVVVLDGRIVGRGCNRALSLNDPTAHAEILALREAGTTIGNYRLLDCDLYSTFEPCPMCAGAITHARVRRLVYGVENSKTGAVRSMLNVLNYPQLNHKVEVTSGVLAARCMQLVCSFYREPRAVFNNNR

SEQ ID NO: 1569 - protein, 142 aa, unidentified
  source 1..142: note = mutated adenine deaminase_MG135-4v3
MEEALREAGRARHAGEVPVGTVIVLENKIVGRGFNRAISLADPTAHAEVIALREAGKNLGNYRLRGCELFSTFEPCAMCAGAMVHARIKRLIYGVDNSKTGAVKSVMNVINYADLNHRMEVVGGVLAGRSSQLLCEFYRSPR

SEQ ID NO: 1570 - protein, 155 aa, unidentified
  source 1..155: note = mutated adenine deaminase_MG135-5v4
MADPVTEQSDELWMEEAIRCAQRAREIGEVPVGAVVVLDGRVVGRGWNRALALNDPTAHAEIVALRDAGATIGNHRLVDCELFSTFEPCTMCAGALVHARIRRLVYGVYNSKTGAVRSVLNVLNYPQLNHRMDVRGGVLAGRSAEILCEFYKKPR

SEQ ID NO: 1571 - protein, 174 aa, unidentified
  source 1..174: note = mutated adenine deaminase_MG135-6v5
MSGSKPRARPPARQSSQAVPESHPQNPPDELWMEEALRCAQRAREANEVPVGAVVVLDGQIVGRGWNRAITLSDPTAHAEIIALREAGATVGNYRLEHSELFSTFEPCAMCAGALTHARVRRLVYGVDNSKTGAVRSVMNTLNYPQLNHKVEVRGGVLAGRSAELLCSFYRSPR

SEQ ID NO: 1572 - protein, 142 aa, unidentified
  source 1..142: note = mutated adenine deaminase_MG135-8v6
MEEALRCAQRARESGEVPVGAVVVLAGRIIGRGWNRAIGLFDPTAHAEIAALREAGATLGNHRLGDCDLFSTFEPCAMCAGAMTHARIRRLVYGVENSKTGAVRSVMNVLNYKHSNHRIEVRSGVLAGRSAELLCTFYRNPR

SEQ ID NO: 1573 - protein, 157 aa, unidentified
  source 1..157: note = mutated adenine deaminase_MG135-7v7
MMSPDEQWMEVALQQAAEARRLGEVPIGAVVVLDGAIVGRGANRALNLADPTAHAEVVALREAARTLGTQRLVACEMFSTFEPCAMCAGALTHARIRRLVYGVDNSKTGAVHSVMNVLNYPQLNHKMEVLGGVLQERCGELVCDFYRSPRAESKIKS

SEQ ID NO: 1574 - protein, 155 aa, unidentified
  source 1..155: note = mutated adenine deaminase_MG135-3v8
MEPTDELWMAEAIREAHLARAGGEVPVGAIIVLGGRIAGRGGNRAIRLSDPTAHAEIIALREAGHHMGNHRLPDCVMYSTFEPCAMCAGALMHARLARLVYGVDNSKTGGVHSVTNVLNYPRLNHHMQVTSGVLAARSSDLLCAFYREPRVKTAE

SEQ ID NO: 1575 - protein, 167 aa, unidentified
  source 1..167: note = mutated adenine deaminase_MG137-1v1
MSFNVLTQHHFSSDDEKWMRLALEQASFARMQGEIPVGAVIVLQNQVIGVGYNAAITSQDPTAHAEIVALRDACARIQNYRLPDDAVLYSTLEPCTMCVGALIHARIHKVIFAVYNSKRGSLLSARNLLNYNGYYNHVFEYQDGCLQQEASALLCTFYKKPRAEKKQ

SEQ ID NO: 1576 - protein, 178 aa, unidentified
  source 1..178: note = mutated adenine deaminase_MG137-2v2
MAVLTNPMTGADETDDYWMNRALALAAQARESGEVPVGAVIVLDGREVGAGFNGAIGQCDPTAHAEIRAIRDAGARAGNYRLPGATLYSTLEPCTMCVGAIVHARISRLVFGVLNSKRGAVESVRNTLNYDHFNWQVAVTGGVMASQCKDIICRFYADPREKHRLRKQKSSGINQQPL

SEQ ID NO: 1577 - protein, 167 aa, unidentified
  source 1..167: note = mutated adenine deaminase_MG137-4v3
MSELPKNDEYWMARALVLAERARSIGEVPVGAIVVLHGQELGVGYNAAITGCDPTAHAEIRALRDASARAGNYRLTGATLYSTLEPCTMCVGAIVHSRISRLVYGVRNSKRGAVESARNTLNYAHLNWQVDAEGGVLEGECGQIICDFYSRPRAEIRRRRKQNSGIN

SEQ ID NO: 1578 - protein, 167 aa, unidentified
  source 1..167: note = mutated adenine deaminase_MG137-6v4
MSEVTAEDEYWMNRALQLAGEARAKGEVPVGAVVVLDGGEIGAGFNAAISGCDPTAHAEIRALRDAAARVGNDRLPHATLYSALEPCTMCVGAIVHGRISRLVYGVSNSKRGAIESARNTLNYPHLNWGVTAVGGVLSDQCSQVICEFYSRPRAEIRRLRKQNSGIN

SEQ ID NO: 1579 - protein, 167 aa, unidentified
  source 1..167: note = mutated adenine deaminase_MG137-17v5
MPDISDDRHWMSRALQLAQQARAAGEVPVGAIVVLDGQEVGAGFNAAISACDPTAHAEIRALRDAAARVGNYRLSGATLYSTLEPCTMCVGAIVHGRISRLVYGVTNSKRGAVESARNTLNYPHLNWAVEATGGVLEQQCSEIICEFYSRPRAEIRRQRQSSSPGIN

SEQ ID NO: 1580 - protein, 179 aa, unidentified
  source 1..179: note = mutated adenine deaminase_MG137-9v6
METTSVMTPDVDDERWMRAALALAERARALGEVPVGAVVVLDGEVIGEGWNQAISGQDPTAHADIMALRDAARRVGNYRLVDADLYSTIEPCTMCAGAIVHARIRRVVFGVSNSKRGALISRQNLLNYPWLNHRVSWTGGVLAEHCSERICAFYRAPREERRRQRQLQSPSINGGSGLG

SEQ ID NO: 1581 - protein, 158 aa, unidentified
  source 1..158: note = mutated adenine deaminase_MG137-11v7
MQEALLEAAKARALSEIPVGAVVVLEGEIIGRGYNCAISSVDPTAHAEIQALRDAASRVGNYRLPGATLYSTLEPCSMCAGAIVHSRVERVVFAVTNSKRGVVESQGNFFNYPFLNHKVQCCGGVLQEAASQQICQFYQYPREQKKRLKRLSSPSINE

SEQ ID NO: 1582 - protein, 164 aa, unidentified
  source 1..164: note = mutated adenine deaminase_MG137-12v8
MPAVTGIAVSPMSEARWMEEALALAEQARALGEVPVGAVIVLGGGVIGRGFNRAISSSDPTAHAEIEAIRDAARTVGNYRLPESEMYSTIEPCTMCTGALVHARIARLIYGVPNSRRGAVCSQSNLLNYGHFNHRVSYEGGLLEARCAALLCRFYQAPRAARQP

SEQ ID NO: 1583 - protein, 155 aa, unidentified
  source 1..155: note = mutated adenine deaminase_MG137-13v9
MPHSDEHWMRQALARARQGRATGEVPVGAVIVLNDTVIGEGWNQAITSADPTAHAEIVALRSAAQQQHNYRLPDATIYSTIEPCTMCAGALIHSRIKRLVFGVPNSRRGAVCSHFNLLNYEGIYNHRVAWEQGVLAEDCAQLICSFYQAPRKPVE

SEQ ID NO: 1584 - protein, 155 aa, unidentified
  source 1..155: note = mutated adenine deaminase_MG137-15v10
MQQHSTDQHWMRLALELADRARAEGEVPVGAVLVLAGELLGSGYNRAIGACDPSAHAEINALRAAALAESNYRLAGATLYSTLEPCTMCVGALVHARVARLVFAVRNSKRGMVCSNANLLNYPHYNHRVQWQEGVLAAESAARLCAFYRAPRQSG

SEQ ID NO: 1585 - protein, 166 aa, unidentified
  source 1..166: note = mutated adenine deaminase_MG137-5v11
MGKVQIIDRSQDARFMRLALELAARGRALGEVPVGAVLVLDGEVVGEGFNCAISAHDPSAHAEMVAIRAAAKAAGNYRLPGSTLYSTLEPCSMCAGLIVHARISRVVYAVSNSKRGVVISRGNFFNYDFLNHRVLAEGGVLAQESAELLCGFYQAPRRGASQPVSG

SEQ ID NO: 1586 - protein, 162 aa, unidentified
  source 1..162: note = mutated adenine deaminase_MG137-14v12
MSPASSAIEEQEQHESWMRLALEQAQLARAADEVPVGAVLVLDRVLVAAGHNQAIGACDPTAHAEIVTLRKAAQAAENYRLPGSVLYSTIEPCTLCLGAIIHARVDTLVFAVRNSRRGAVVSRQNLGNYQYFNHQPAVIEGVLAIDSAALMCAFYAGPRSGQ

SEQ ID NO: 1587 - protein, 153 aa, unidentified
  source 1..153: note = mutated adenine deaminase_MG137-16v13
MDTTSHAHWMALALERAREARRQDEVPVGALLVLGGEALGEGSNRAVSSHDPTAHAEIIALREAARREGNYRLPGSVLYSTIEPCTMCVGAIIHARIDLLVFGVRNSRRGAVVSARNLLNYDRYNHHPAVLEGVLADECGDLMCGFYRAPRNR

SEQ ID NO: 1588 - protein, 173 aa, unidentified
  source 1..173: note = mutated adenine deaminase_MG137-8v14
MISDDAGELDDIAAMRLALEQARLARGEGEVPGGAGVVLEGKVIGTGYNGAIGGLDPSAHAEMRAIRQACLTVGNYRLPGATLYSTVEPCTMCAGLLVHSRISRLVYGVANSKRGAVVSNLNLLNYGPYNHRIEVAGGVLADECSALMCEFYARPRARKKALKQSTINAKPAS

SEQ ID NO: 1589 - protein, 157 aa, unidentified
  source 1..157: note = mutated adenine deaminase_MG137-3v15
MIRSDEFYMHRALDQAHLARVEGEVPVGAVVVDLQGTIIGAGRNSAVASCDPSGHAEIRALREAGQQLGNYRLEGCTLFSTLEPCMMCAGAMVHARLARLVYGVANSRRGMVESKANLLNYPWFNHQVAVTRGVLAAPAKKLLCQFYATPRESITQR

SEQ ID NO: 1590 - protein, 158 aa, unidentified
  source 1..158: note = mutated adenine deaminase_MG68-55v1
MPDLDDGYWMQQALKLAAQARDQGEVPVGALVVLEQKLLGQGYNQAISLQDPSAHAEVMALRGAGITQQNYRLVNTTLYSTFEPCMMCAGVLVHARIKRLVFGVYNSKRGAISSCANLLNYPHLNHQILVQGGILAKECGQQLCDFYKAPRQVFNDKG

SEQ ID NO: 1591 - protein, 164 aa, unidentified
  source 1..164: note = mutated adenine deaminase_MG68-27v2
MREEKDLIFMKKALHLAEEARRQGEVPVGAVVVDLEGQIIGQGYNQAIALLDPTAHAEIVALRQAAKKKKNYRLSGSTLYSTFEPCPMCLGAMVQARIDRLVFGVYNSKRGAVSSIMNFNYDKMNHRFEIEGGLLSQECATILCEFYQSPRGVFNNKKETAKIN

SEQ ID NO: 1592 - protein, 153 aa, unidentified
  source 1..153: note = mutated adenine deaminase_MG68-52v3
MRLAMDMAKEARSIGEVPVGCVIADLDGNVISTGYNRAITLNDPSAHAEMVAIRNAGSLLKNYRMPGLSLYSTFEPCCMCSGAIIHARIARVYYGVSNSKRGACGSVFNVMNYPRHNHSVECIGGILADECSKMLCDFYKEPRQVFNAEATKL

SEQ ID NO: 1593 - protein, 168 aa, unidentified
  source 1..168: note = mutated adenine deaminase_MG68-15v4
MEPMEEHRHFMGLAIEEAARARELNEVPVGAVLVGLAGEILSRASNAAIRLADPSAHAEMIALRQAARASGNYRLPGSVLYSTFEPCVMCVGAMLHARIATLVFGVRNSRRGAAGSVVNLTNYPAFNHYVRVIAGVRAEECSELLCRFYREPRRVFNSGYGGEVPKIN

SEQ ID NO: 1594 - protein, 158 aa, unidentified
  source 1..158: note = mutated adenine deaminase_MG68-58v5
MSLADRHEMFMQMALQQAQLARDCAEVPVGAVVVNLAGEVIGKGYNRAIILSDPTAHAEIVALRQAAAHEQNYRLPDLTVYSTFEPCVMCIGALTHARIAHVVYGVSNSKRGACGSVLNIQNYKKINHHTRITSGVLEQACAEKLCHFYREPRKVFNL

SEQ ID NO: 1595 - protein, 168 aa, unidentified
  source 1..168: note = mutated adenine deaminase_MG68-25v6
MDDQHWMGRALALAERAREQGEVPGGAVLVLENEIVGEGWSRAIALQDPSAHAEILALRDAGLRRGNYRLSGSVLYSTFEPCVMCAGAIVHARVDTLVFGVANSKRGACGSVFNLLPNYGRFNHHTQCRGPILADACGTILCAFYANPRAVFNARANASAAHERPEIN

SEQ ID NO: 1596 - protein, 191 aa, unidentified
  source 1..191: note = mutated adenine deaminase_MG68-18v7
MQKKVDDFLKIVEPPDAERRTKGKLLQQRAVDEQWMGLALQRGEEARRQGEVPVGAVVVLKDGFLTAAGNSAIGLADPSAHAEMLAIRAAAKLLGNYRLPEATLYSTFEPCIMCMGALIQARISRLVFGVANSKRGAAISVYNIGNYQRLNHTVAVTGGILAEACAQLLCNFYKKPRGVFNVINSPFLKIN

SEQ ID NO: 1597 - protein, 180 aa, unidentified
  source 1..180: note = mutated adenine deaminase_MG68-45v8
MTALITTSNIHDKMMSLALKEAFKARKLGEIPVGCVITDLNNELVATGFNRAIILNDPSAHAEIVALRKAGEKLQNYRLVNLNLYSTFEPCTMCSGAIIHARIKRVFFGVYNSKRGACGSVFNVLNYDRHNHKVEIYGGILKEECSSMLCDFYKAPRKVFNEGRDWIVESGKDRTWLNIN

SEQ ID NO: 1598 - protein, 205 aa, unidentified
  source 1..205: note = mutated adenine deaminase_MG68-13v9
MPEPFQGGDPADPARAAAEAQDLADRAFMRLALDQAHNARLLGEVPVGAVIVLEGRVLATGYNRAIGLSDPTAHAEIVALRQAASLLGNYRLPGCTLYSTFEPCAMCAMALLHARIERVVFGVSNSKRGAAGSVLNLFNYPLLNHHASLRAGVEAQACGALLCEFYREPRAVFNAQQQLPAHGGGIDVRHLDAPEPGDESDPFIN

SEQ ID NO: 1599 - protein, 167 aa, unidentified
  source 1..167: note = mutated adenine deaminase_MG68-4v10
MTDSQNDTDEYWMGEALKLAQKARDEGEVPVGAILVLKGEVIGHGWNRAIGLHDPSAHAEIMAIREAGVRIGNYRMLDTVLYSTFEPCAMCAGALVHGRISRLVFGVENSKRGACGSVMNIANYPALNHQLQVDGGVMAAPCARLLCDFYRWPRAQKKAARDNSSIN

SEQ ID NO: 1600 - protein, 159 aa, unidentified
  source 1..159: note = mutated adenine deaminase_MG132-1v1
MQPTDPFHLQHMELALEEAGLARAQDEVPIGAVIVLLEKGIIARAHNQAEMLQDPTAHAEMIAISHAAGALGSWRLEDTILYSTFEPCPMCAGAIVQARVPFVVYGVNNSKRGACHTLYNITNYPRLNHRCHVLGGVLSERCAAILCEFYAAPRRLGKK

SEQ ID NO: 1601 - protein, 171 aa, unidentified
  source 1..171: note = mutated adenine deaminase_MG132-1v2
MIDPFSPFDLTFTDPHHPFHLHHMELALEEAAAARREDEVPVGCVIILPERGIIASAHNQAEQLTDPTAHAEMIAITQAAASLKSWRLEQCILYSTFEPCPMCAGAIVQARIPVVAFGVTNSKRGACTTLYNIANYPRLNHRARIIGGIQAARCAAMLCNFYQRPRAMGKK

SEQ ID NO: 1602 - protein, 149 aa, unidentified
  source 1..149: note = mutated adenine deaminase_MG132-1v3
MLLALDQARIARAHDEVPIGAVLYLLPTRNIIGQAHNRAILLADPPAHAELLAIRQGAQTLGDWRLTDTILASTFEPCPMCAGAIVNARIPQLVYGVANSKRGAVQTLYNLCNYPRLNHRVQLTAGVRSDDCSALLCSFYAAPRAMGKK

SEQ ID NO: 1603 - protein, 165 aa, unidentified
  source 1..165: note = mutated adenine deaminase_MG133-1v1
MNGPRAHEIDDRMMGAALDAARAARSIGEVPIGAVVYLGEDVLGTGHNRAETLADPSAHAEVLAIRAAAHAIGDWRLEGCSIASTFEPCPMCAGLIVNARLERLVYAVANPKAGAVETLYNLCNYARLNHRASEIRAGVREAEAAGLLCGFFRDPRAVFNGPPDA

SEQ ID NO: 1604 - protein, 147 aa, unidentified
  source 1..147: note = mutated adenine deaminase_MG133-2v2
MMRRALDLAAAAREEGEVPVGAVIYDTLTGETLGEAANRAEALRDPSAHAEFTAIRRACSKINDFRLNRCSLASTFEPCPMCAGLIVNARVGRVVYGVDNPKAGAVRSLYNILNYARLNHRCEVIPGVLADESADLLCSFFRGPRAR

SEQ ID NO: 1605 - protein, 172 aa, unidentified
  source 1..172: note = mutated adenine deaminase_MG133-7v3
MLARLKNLFTKPKQANDATEIDDRMMVRALELARDARGAGEVPVGAVVYVNLTGEIIGEGANRAETLNDPSAHAEHIAIVRAAERLGDWRLNHCTVVSTFEPCAMCAGLIVNARLGRVVYGVDNPKAGACRSLFNIANYPRLNHRAQIIAGVRHDECAQVLCTFFRGPRAKG

SEQ ID NO: 1606 - protein, 167 aa, unidentified
  source 1..167: note = mutated adenine deaminase_MG133-4v4
MRQPEPPQPTTTDIEMMERAIELAQQSRDAGEVPVGAIVYNTLTGEIVAQAHNTADMLNNPAGHAEFSAIQSACNSIGDWRLNDCTLVSTFEPCPMCAGLIVNARVGRLIYGVSNPKAGAVRSLFNLCNYTRLNHRCEIHTGVLGDRCSDQLCTFFRDPRAVFNSNG

SEQ ID NO: 1607 - protein, 161 aa, unidentified
  source 1..161: note = mutated adenine deaminase_MG133-12v5
MTADPAKVCARDEQAMSRAIELAREARAMGEVPVGAVVYRTLTGETLGEGYNRAETLDDPTAHAEILAIRQAATKIGDWRLNECTLVSTFEPCVMCAGAIVNARVGRLVYGVINPKAGGVESLYNIPNYNRLNHRPTILPGLMAEACGELLCAFFRSPRGK

SEQ ID NO: 1608 - protein, 180 aa, unidentified
  source 1..180: note = mutated adenine deaminase_MG133-5v6
MVGWLSRVLGMRRGAAAPGAPASATSTDVNMMGRALELARQARAIGEVPVGAVVYETLSGRILGEGFNRAEILHDPAAHAELTAIRAAAAARGDWRLNDCTLVSTFEPCAMCSGLIVNARIGRLVYGVANAKAGATESLYNLTNYPRLNHRVEPVAGVMAEECGALLCEFFRGPRAVFNR

SEQ ID NO: 1609 - protein, 162 aa, unidentified
  source 1..162: note = mutated adenine deaminase_MG133-9v7
MTAGAPTDLDRAMMRRALDRARDARAMDETPVGAVVYETLTGRILAEAHNRAEALDDPTAHAELIAIRHAARAVGDWRLNDCTLVSTFEPCAMCAGAIVNARVGRLVYGVSNPKAGAVESLYNLCNYARLNHRIEPIGGVDAEECGGLLCEFFRAPRSVFND

SEQ ID NO: 1610 - protein, 168 aa, unidentified
  source 1..168: note = mutated adenine deaminase_MG133-14v8
MMAPPEQPAAPLPPTEATETDLAMMRRALDLARSAREAGESPVGAVVYETLTGRILAEAHNTAEALKDPCGHAELIAARAAAKALGDWRLNGCTLVSTFEPCAMCAGMIVNARFGRVVYGVSNPKAGAAESLYNLTNYARLNHRVRPVAGVLAGESAQMLCEFFRQPR

SEQ ID NO: 1611 - protein, 168 aa, unidentified
  source 1..168: note = mutated adenine deaminase_MG133-8v9
MADAVDEFDLTMMRRALAQAERARAMHEVPVGAVVYELLSRAVLAEAHNRAEILADPTAHAEMLALRAAARRRGLWRLDGCAIASTFEPCPMCAGALVNSRIDRLVYGVANPKMGCVETLYNLCNYERFNHRLEVRGGVLAEPCAAVLCEFFKAPRGVFNAPKPKPGT

SEQ ID NO: 1612 - protein, 152 aa, unidentified
  source 1..152: note = mutated adenine deaminase_MG133-10v10
MMARAIELAQHARSIGEVPVGAVVYLNTEVLGEGYNRAESLRDPTAHAEMLALRQAAEQRGSWRLEDCSLASTFEPCPMCAGAIVNARIARLVYGVANPKMGCVQTLHNLCNYQRFNHRVQLIACIEAERCGQLLCEFFQAPRNVFNKGKPS

SEQ ID NO: 1613 - protein, 180 aa, unidentified
  source 1..180: note = mutated adenine deaminase_MG133-13v11
MIRFRSDITRRNERIRARQRSWSATNHAMMGLALDLAGQARAIGEVPVGAVVVLRGRVVGEGFNRAESLADPTSHAEIEAIREAATALGDWRLSECTLYSTFEPCPMCAGAIVNARVGRLVYGVTNPKAGAVASLYNLCNYARLNHRVEVLGGVRARECGLVLCRFFRGPRRVFNASRRR

SEQ ID NO: 1614 - protein, 175 aa, unidentified
  source 1..175: note = mutated adenine deaminase_MG133-3v12
MHQVRLQTERHPDVTDVDIEMMQRAIKLAKKARTLGEVPVGAIVYLGSKVLAEGYNVAESLSDPTGHAELIAISKAGKALGDWRLTDCSLASTFEPCPMCAGALVNARLGRLIYGVANPKAGACHTLYNIPNYDRLNHRVAMIGGVMANECRALLCDFFQQPRQVFNDTRNARSA

SEQ ID NO: 1615 - protein, 175 aa, unidentified
  source 1..175: note = mutated adenine deaminase_MG133-6v13
MQQLKLVQSDSVRATEVDVDMMKRAIELANLARAMEEVPVGAVVYLGNKIIAEAHNNAEQLADPTGHAELLAIRLASEKLDSWRLNDCALASTFEPCPMCAGAIVNSRISRVVYGVTNPKAGACESLYNILNYDRLNHQVEMVSGVLASECSKLLCDFFKEPRKVFNERRLRNAS

SEQ ID NO: 1616 - protein, 172 aa, unidentified
  source 1..172: note = mutated adenine deaminase_MG133-11v14
MDLTDLDTRMMRLALEQARAARDAGEVPVGAVVYLGEEVLAKAHNMAEALADPTAHAELIALREAAKTIGTWRLDGCRLASTFEPCPMCAGALVNSRLEAVVYGVTNPNMGCVESLHNLLNYRAFNHRVSWQGGVLADASLALLCGFFKAPRGVFNPPKPTSQTGQADATRP

SEQ ID NO: 1617 - protein, 172 aa, unidentified
  source 1..172: note = mutated adenine deaminase_MG136-1v1
MTASTESLCLPDRRREEHYMRLALDQARQARKADEIPVGAVVVLGGRVIGRGFNSAIGLNDPTAHAEILALRESALTVDNYRLEEATVFSTFEPCVMCAGALVAARVRRLVFAVRNSRRGAVRSKFNLANYELLNHRVQVEEGLLAAECGDLVCAFYQRPRERPLPGLDGSA

SEQ ID NO: 1618 - protein, 148 aa, unidentified
  source 1..148: note = mutated adenine deaminase_MG136-6v2
MSGDVFMREALALACQARANGEVPVGAVVVLGGEVRGRGSNAAIRLNDPTAHAEMLAIREAAAAIGNYRLEGAILYSTFEPCVMCAGALVAARVGRLVFGVRNSRRGGGRSKFNLANYELLNHRLEIVEGVLAADCLALVCRFYEQPR

SEQ ID NO: 1619 - protein, 158 aa, unidentified
  source 1..158: note = mutated adenine deaminase_MG136-12v3
MSNYSGSAAAGDEAWMRRALGLARRAREEGESPVGAVIVGLDGRLLAEAHNAAIGLHDPTAHAEIVALRAAARALGNYRLNGTTMYSTFEPCVMCAGALVHARVKRLVFGVRNSRRGGVRSKFNLANYDLLNHRLEIEEGPMAAEATALLCEFYRAPR

SEQ ID NO: 1620 - protein, 150 aa, unidentified
  source 1..150: note = mutated adenine deaminase_MG136-2v4
MRQALAAAHEARERGEVPVGACIVLGDVILAVAGNRARTLSDPTAHAEIVALRNAAKSGNYRLTDARVYSTFEPCVMCAGALIQARVSRLVYGVRNSRRGAVESHFNVCNYDFLNHRIAVTAGVLEAECRELMCRFYRAPRGNQGMRAEG

SEQ ID NO: 1621 - protein, 165 aa, unidentified
  source 1..165: note = mutated adenine deaminase_MG136-3v5
MKAAEERENAAQWMRQAVAAAHGARERGEVPVGACIVLGETILAVAGNRAITLQDPSAHAEIVALREAARKIANYRLTNAVVYSTFEPCVMCAGALIQARVKRLVYGVRNSRRGAIESRFNVCNYDFLNHRIEVTAGVLENECREIMCEFYRAPRCGTAGAKLEG

SEQ ID NO: 1622 - protein, 153 aa, unidentified
  source 1..153: note = mutated adenine deaminase_MG136-9v6
MITTDIDEKWMRAAIEAARSARDLGEVPVGACLVDLGGNLLSIASNRAITLHDPSAHAEMLALREAAAKVENYRLTGVTAYSTFEPCVMCAGALVNARVARLVFGVHNSRRGAVESKFNICNYELLNHRIEIVPGVLADECRALICEFYRAPR

SEQ ID NO: 1623 - protein, 164 aa, unidentified
  source 1..164: note = mutated adenine deaminase_MG136-10v7
MNELDEIWMREAIRAARAARTLGEVPIGACLIDLEGALLAVAGNRAITLTDPTAHAEILVLREASALIHNYRLVDTTIYSTFEPCTMCAGALVNARIRRLVYGVANSRRGAVRTLFNLCNYQALNHRIEIVAGVLEAECRALVCNFYRKPRDVFNSQKINADQT

SEQ ID NO: 1624 - protein, 142 aa, unidentified
  source 1..142: note = mutated adenine deaminase_MG136-11v8
MWRTLHLAREARKLGEVPIGAIIIDLKGKILAATSNRAITLSDPTAHAELMAIRTAGMRIGNYRLNGTTMYSTFEPCVMCAGAIVNARVERLVFGVHNSRRGAVETLFNIGNYRKLPPSAAGFLSRPPRPLRPLCQDPEAPA

SEQ ID NO: 1625 - protein, 165 aa, unidentified
  source 1..165: note = mutated adenine deaminase_MG129-1v1
MTHPVPELDQLMQPAIDEARAARTPPRRDIPIGAAVLDEEGRLIASAGNRAEALEDPTAHAEILALREAARVRGRWNLTGCTLASTFEPCTMCAGAIVLARIDHLVVGVMNSKRGAAGSLYNLVREERLNHRVRLTTGVREIECAQMLCGFYRDPRERRKGLRAG

SEQ ID NO: 1626 - protein, 154 aa, unidentified
  source 1..154: note = mutated adenine deaminase_MG129-2v2
MSDEAFMQQALALAREARALGEVPVGAVAVLDGRPIGTGFNRAEVLRNPLAHAELLALDEARKALGVWRLTGVTLYSTFEPCAMCAGALVQSRVTRLVFGVMNSKRGAVGSLYNLANYPRHNHRLQVTSGIMADESRLLLCGFYERPREKRRDK

SEQ ID NO: 1627 - protein, 158 aa, unidentified
  source 1..158: note = mutated adenine deaminase_MG129-11v3
MATEPDETYMREALELAARARALGEVPVGAVAVLEGRVIGRGFNRAEVLRDPFSHAELLALGEASRALGAWRLSGVTLFSTFEPCAMCAGAMVQARVDRLVFGVRNSKRGAVGSLYNLANYPRHNHRVAVTEGVLAEESGTILCGFYRSPRERRRTSE

SEQ ID NO: 1628 - protein, 174 aa, unidentified
  source 1..174: note = mutated adenine deaminase_MG129-3v4
MSEPHPFDAAMREALSLAAEARAAGEVPVGAVAVLGGEVVGRGRNRAEELRDPCAHAELLAIREAARTLGRWRLTGVTLVSTFEPCAMCAGALVLARVDRLVYGVPNSKRGAVGSLMNLSNYPRLNHRFPVERGLRADECGEQLCAFYRSPRATSGASGENSGSSALGSGGEIG

SEQ ID NO: 1629 - protein, 177 aa, unidentified
  source 1..177: note = mutated adenine deaminase_MG129-7v5
MSTGTNVHPFDAAMQEAIALADEARRAGEVPVGAVAVLDGKVVGRGRNRAEELRDPCAHAELLALRDAARTLGRWRLTGVTLVSTFEPCAMCAGALVLARVDRLVFGVLNSKRGAVGSLMNLSNYPRLNHRFPVDRGVRGEECAAQLCAFYRLPRASPGGGGENSGSSELGSGGEIG

SEQ ID NO: 1630 - protein, 150 aa, unidentified
  source 1..150: note = mutated adenine deaminase_MG129-4v6
MREALALARDARARGEVPVGAVAVLEGRVVGRGANAAEFLRDPTAHAELLAIRDAARTLGRWRLTGVTLVSTFEPCAMCAGAMVLARIDRLVYAVNNSKRGAVGSLLNLSNYPRLNHRFEVVRGVLGDEAGELLCSFYRAPRGGGNGSEG

SEQ ID NO: 1631 - protein, 151 aa, unidentified
  source 1..151: note = mutated adenine deaminase_MG129-9v7
MDLPHEHFLDLALEEARRARGEDEVPVGAVAVLEGAVVGRGRNAAERLRDPLAHAELDALREASRNLGRWRLSGVTLYSTFEPCAMCAGAMVNARIERLVYGVDNSKRGAVRSLYNICNYDRLNHRVEVIGGVRAAESSELLCEFYRGPRK

SEQ ID NO: 1632 - protein, 149 aa, unidentified
  source 1..149: note = mutated adenine deaminase_MG129-10v8
MGEALDVARRARSMGEVPIGAVVVLDGAVLATAHNRAEILRDPTAHAELLALRQAAGTLGDWRLDGATVYSTFEPCAMCAGAMVLARIAACVYAVPNSKRGFLGTLGNLSNYDGLNHRFGVRAGVRADEASEMLCSFYRGPRGGREGVD

SEQ ID NO: 1633 - protein, 141 aa, unidentified
  source 1..141: note = mutated adenine deaminase_MG129-12v9
MDFMSTALELARAARQMGEVPVGAVAVLGGVIIGRGHNRAETLHDPFAHAELLAMREAAQHLRSWRLTDVTVYSTFEPCAMCAGAMAQARLGAVVFGVDNSKRGRADLLVNHNHTVKVTRGVEAEQASVLLCEFYARPRAT

SEQ ID NO: 1634 - protein, 167 aa, unidentified; identical to SEQ ID NO: 1599
  source 1..167: note = mutated adenine deaminase_MG130-3v1

SEQ ID NO: 1635 - protein, 167 aa, unidentified
  source 1..167: note = mutated adenine deaminase_MG130-1v2
MSVESPVEGVDTADAADAVWMAHALDEARAARAAGDVPVGAVVVLEGVIVGRGRNRAEVLRDQTAHAELVALREAAREPGHWRVEAALFSTFKPCPMCAGAIVNARVRRLVFGVLNSKRGAVTTLYNIPNYPRLNHHVEVVGGIRSEECAALLRAFYAEPRRVFNYR

SEQ ID NO: 1636 - protein, 216 aa, unidentified
  source 1..216: note = mutated adenine deaminase_MG130-5v3
AKPAYGVYLYRGFESLPVRNKHSIDFGSVAQWIEHRSTEPGVRGSTPLGSASRRQHMTSPTMTDDQWMHVALSEARAARATGDVPVGAVIVLADGTLLGRGRNRAELLKDPTAHAEIVALREAAHALGMWRVDATIYSTFEPCPMCAGALVNARIARLVYGVPNSKRGAIASLFNIVNYPRLNHRIDVTSGVLSTECAAVLSQFYAEPRRVFNYGT

SEQ ID NO: 1637 - protein, 193 aa, unidentified
  source 1..193: note = mutated adenine deaminase_MG130-2v4
MSLAGSRVISMSLERDTETADHAFMGEAIEAARKARAAGDVPVGAVIVLDDEIIAHGHNRAQVLSDPTAHAEIEALRAASRIVGNWRIEGTLYSTFEPCPMCAGALVNARVKRLVYGVSNSKRGSVHTLYNIVNYVRLNHRMEVTAGVRQEECADLLRQFYADPRRVFNTGSHAGDETGHGTDGDPGDSPGGH

SEQ ID NO: 1638 - protein, 189 aa, unidentified
  source 1..189: note = mutated adenine deaminase_MG130-4v5
MTSQEWMHEAINCARQARAADEVPIGCVIVLLPTAQIIGRGFNQAETLHDPTAHAEILAMREAGAALNHWRLLDCALISTFEPCPMCAGAIVNARIPKLIYGVDNSKRGAVRTLYNLVNYHVRFTGSPRGKKILDNWDHLIARFYKVMPIEYKRVLEPRRVFNRPRSLLIGPADRSESGPLHTRGVANG

SEQ ID NO: 1639 - protein, 972 aa, unidentified; identical to SEQ ID NO: 1356
  source 1..972: note = MG68-4_nMG34-1 (D10A)

SEQ ID NO: 1640 - protein, 972 aa, unidentified
  source 1..972: note = MG68-4 (D109Q)_nMG34-1 (D10A)
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAEQPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1641 - protein, 972 aa, unidentified; identical to SEQ ID NO: 852
  source 1..972: note = MG68-4 (D109N/H129N)_nMG34-1 (D10A)

SEQ ID NO: 1642 - protein, 972 aa, unidentified
  source 1..972: note = MG68-4 (D109Q/H129N)_nMG34-1 (D10A)
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAEQPKTGACGSVMDIARHPALNNQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1643 - protein, 972 aa, unidentified; identical to SEQ ID NO: 843
  source 1..972: note = MG68-4 (D7G/E10G/D109N)_nMG34-1 (D10A)

SEQ ID NO: 1644 - protein, 972 aa, unidentified
  source 1..972: note = MG68-4 (D7G/E10G/D109Q)_nMG34-1 (D10A)
MTDSQNGTDGYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAEQPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEEGADKRTADGSEFESPKKKRKV

SEQ ID NO: 1645 - DNA, 30 bp, unidentified
  source 1..30: mol_type = unassigned DNA; note = ssDNA substrate for testing ADA in vitro
attattattattagcattattattattata

SEQ ID NO: 1646 - DNA, 90 bp, synthetic construct
  source 1..90: mol_type = other DNA; note = ssDNA substrate for testing ADA in vitro
tcccttgtctccctgttggtccgctgccttgctcgctcgctcgttcgctctttcgatatagaagacacgtcttgctgcgcttgctcttcg

SEQ ID NO: 1647 - protein, 1134 aa, synthetic construct
  source 1..1134: note = MG3-6/3-8 effector
MSTDMKNYRIGVDVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEG

SEQ ID NO: 1648 - RNA, 110 nt, synthetic construct
  source 1..110: mol_type = other RNA; note = MG3-6/3-8 effector sgRNA
  misc_difference 1..22: note = N can be a or c or g or u
nnnnnnnnnnnnnnnnnnnnnngttgagaatcgaaagattcttaataaggcatccttccgatgctgacttctcaccgtccgttttccaataggagcgggcggtatgtttt

SEQ ID NO: 1649 - protein, 15 aa, synthetic construct
  source 1..15: note = Linkers evaluated for nMG35-1 fusions with a TadA deaminase
GGGGSGGGGSGGGGS

SEQ ID NO: 1650 - protein, 17 aa, synthetic construct
  source 1..17: note = Linkers evaluated for nMG35-1 fusions with a TadA deaminase
SGSETPGTSEASTPESA

SEQ ID NO: 1651 - protein, 26 aa, synthetic construct
  source 1..26: note = Linkers evaluated for nMG35-1 fusions with a TadA deaminase
GGGGSGGGGSEAAAAKGGGGSGGGGS

SEQ ID NO: 1652 - protein, 32 aa, synthetic construct
  source 1..32: note = Linkers evaluated for nMG35-1 fusions with a TadA deaminase
GGGGSGGGGSEAAAAKEAAAAKGGGGSGGGGS

SEQ ID NO: 1653 - protein, 44 aa, synthetic construct
  source 1..44: note = Linkers evaluated for nMG35-1 fusions with a TadA deaminase
KGKGKGMGAGTLSTDKGESLGIKYEEGQSHRPTNPNASRMAQKV

SEQ ID NO: 1654 - protein, 7 aa, synthetic construct
  source 1..7: note = : Linkers evaluated for nMG35-1 fusions with a TadA deaminase
PAPAPAP

SEQ ID NO: 1655 - protein, 14 aa, synthetic construct
  source 1..14: note = : Linkers evaluated for nMG35-1 fusions with a TadA deaminase
KLGGGAPAVGGGPK

SEQ ID NO: 1656 - protein, 25 aa, synthetic construct
  source 1..25: note = SACAS9
MKRNYILGLDIGITSVGYGIIDYET

SEQ ID NO: 1657 - protein, 24 aa, synthetic construct
  source 1..24: note = MG1-4
MKKKVFAFDLGKASIGYCVRDGFN

SEQ ID NO: 1658 - protein, 28 aa, synthetic construct
  source 1..28: note = MG1-6
MEKEKNNHVWGFDIGKGSLGEAVRVGGD

SEQ ID NO: 1659 - protein, 28 aa, synthetic construct
  source 1..28: note = MG3-6
MSTDMKNYRIGVDVGDRSVGLAAIEFDD

SEQ ID NO: 1660 - protein, 27 aa, synthetic construct
  source 1..27: note = MG3-7
MSEHTKYRIGIDVGDRSVGLAAIEFDD

SEQ ID NO: 1661 - protein, 28 aa, synthetic construct
  source 1..28: note = MG3-8
MSTDMKNYRIGVDVGDRSVGLAAIEFDD

SEQ ID NO: 1662 - protein, 32 aa, synthetic construct
  source 1..32: note = MG4-5
MGDQQTLQATSYCLGLDVGVQGVGWAVIDLDD

SEQ ID NO: 1663 - protein, 25 aa, synthetic construct
  source 1..25: note = MG7-1
MSNKTILGLDLGVSSIGWAIIERND

SEQ ID NO: 1664 - protein, 38 aa, synthetic construct
  source 1..38: note = MG14-1
MEITINREIGKLGLPRHLVLGMDPGIASCGFALIDTAN

SEQ ID NO: 1665 - protein, 23 aa, synthetic construct
  source 1..23: note = MG15-1
MNYVLGLDVGIASVGWAVLELNE

SEQ ID NO: 1666 - protein, 24 aa, synthetic construct
  source 1..24: note = MG16-1
MIKNILGLDLGVGSIGWALIQTED

SEQ ID NO: 1667 - protein, 27 aa, synthetic construct
  source 1..27: note = MG18-1
MDQSKEYYIGLDGGTDSVGWAVLNPDY

SEQ ID NO: 1668 - RNA, 22 nt, synthetic construct
  source 1..22: mol_type = other RNA; note = MGA1-4
cgtttgccgtctgaatttgacc

SEQ ID NO: 1669 - RNA, 22 nt, synthetic construct
  source 1..22: mol_type = other RNA; note = MGA1-4
gaagatcaggatatgtggcgga

SEQ ID NO: 1670 - RNA, 22 nt, synthetic construct
  source 1..22: mol_type = other RNA; note = MGA1-4 PAL113
acgggtaacagtttctttatgg

SEQ ID NO: 1671 - RNA, 22 nt, synthetic construct
  source 1..22: mol_type = other RNA; note = MGA1-6
cgttgctgcataaaccgactac

SEQ ID NO: 1672 - RNA, 22 nt, synthetic construct
  source 1..22: mol_type = other RNA; note = MGA1-6
aaaacccgaaactgtggagcgc

SEQ ID NO: 1673 - RNA, 22 nt, synthetic construct
  source 1..22: mol_type = other RNA; note = MGA1-6
gattgaaaatggtctgctgctg

SEQ ID NO: 1674 - RNA, 22 nt, synthetic construct
  source 1..22: mol_type = other RNA; note = MGA3-6
tacgggtaacagtttctttatg

SEQ ID NO: 1675 - RNA, 22 nt, synthetic construct
  source 1..22: mol_type = other RNA; note = MGA3-6
gcgttggcaatttaaccgccag

SEQ ID NO: 1676 - RNA, 22 nt, synthetic construct
  source 1..22: mol_type = other RNA; note = MGA3-6
ctgaatatcgacggtttccata

SEQ ID NO: 1677 - RNA, 22 nt, synthetic construct
  source 1..22: mol_type = other RNA; note = MGA3-7
cacatttaatgttgatgaaagc

SEQ ID NO: 1678 - RNA, 22 nt, synthetic construct
  source 1..22: mol_type = other RNA; note = MGA3-7
acacaaatcagcgatttccatg

SEQ ID NO: 1679 - RNA, 22 nt, synthetic construct
  source 1..22: mol_type = other RNA; note = MGA3-7 PAL122
atggatgagcagacgatggtgc

SEQ ID NO: 1680 - RNA, 22 nt, synthetic construct
  source 1..22: mol_type = other RNA; note = MGA3-8
ttcatctgtggtgcaacgggcg

SEQ ID NO: 1681 - RNA, 22 nt, synthetic construct
  source 1..22: mol_type = other RNA; note = MGA3-8
acgagcatcatcctctgcatgg

SEQ ID NO: 1682 - RNA, 22 nt, synthetic construct
  source 1..22: mol_type = other RNA; note = MGA3-8
cgacccgcattgaccctaacgc

SEQ ID NO: 1683 - RNA, 22 nt, synthetic construct
  source 1..22: mol_type = other RNA; note = MGA4-5
cacaaatcagcgatttccatgt

SEQ ID NO: 1684 - RNA, 22 nt, synthetic construct
  source 1..22: mol_type = other RNA; note = MGA4-5
tgatgaagcagaacaactttaa

SEQ ID NO: 1685 - RNA, 22 nt, synthetic construct
  source 1..22: mol_type = other RNA; note = MGA4-5
aatattgaaacccacggcatgg

SEQ ID NO: 1686 - RNA, 22 nt, synthetic construct
  source 1..22: mol_type = other RNA; note = MGA7-1
gaagatcaggatatgtggcgga

SEQ ID NO: 1687 - RNA, 22 nt, synthetic construct
  source 1..22: mol_type = other RNA; note = MGA7-1
aacgtcgaaaacccgaaactgt

SEQ ID NO: 1688 - RNA, 22 nt, synthetic construct
  source 1..22: mol_type = other RNA; note = MGA7-1
aaacccacggcatggtgccaat

SEQ ID NO: 1689 - RNA, 22 nt, synthetic construct
  source 1..22: mol_type = other RNA; note = MGA14-1
tcaaaaaatggctttcgctacc

SEQ ID NO: 1690 - RNA, 22 nt, synthetic construct
  source 1..22: mol_type = other RNA; note = MGA14-1
aagcagcgttgttgcagtgcac

SEQ ID NO: 1691 - RNA, 22 nt, synthetic construct
  source 1..22: mol_type = other RNA; note = MGA14-1
tcagccggaaaacctaccggat

SEQ ID NO: 1692 - RNA, 22 nt, synthetic construct
  source 1..22: mol_type = other RNA; note = MGA15-1
gaagatcaggatatgtggcgga

SEQ ID NO: 1693 - RNA, 22 nt, synthetic construct
  source 1..22: mol_type = other RNA; note = MGA15-1
aacgtcgaaaacccgaaactgt

SEQ ID NO: 1694 - RNA, 22 nt, synthetic construct
  source 1..22: mol_type = other RNA; note = MGA15-1
aaacccacggcatggtgccaat

SEQ ID NO: 1695 - RNA, 22 nt, synthetic construct
  source 1..22: mol_type = other RNA; note = MGA16-1
gccagctggcgtaatagcgaag

SEQ ID NO: 1696 - RNA, 22 nt, synthetic construct
  source 1..22: mol_type = other RNA; note = MGA16-1
agggtgaaacgcaggtcgccag

SEQ ID NO: 1697 - RNA, 22 nt, synthetic construct
  source 1..22: mol_type = other RNA; note = MGA16-1
ctacgtctgaacgtcgaaaacc

SEQ ID NO: 1698 - RNA, 22 nt, synthetic construct
  source 1..22: mol_type = other RNA; note = MGA18-1
aaaacccgaaactgtggagcgc

SEQ ID NO: 1699 - RNA, 22 nt, synthetic construct
  source 1..22: mol_type = other RNA; note = MGA18-1; note = MGA18-PAL144
ggcaactctggctcacagtacg

SEQ ID NO: 1700 - RNA, 22 nt, synthetic construct
  source 1..22: mol_type = other RNA; note = MGA18-1
ccggaaaacctaccggattgat

SEQ ID NO: 1701 - RNA, 20 nt, synthetic construct
  source 1..20: mol_type = other RNA; note = ABE8.17m
tttctttcacagatgtggat

SEQ ID NO: 1702 - RNA, 20 nt, synthetic construct
  source 1..20: mol_type = other RNA; note = ABE8.17m
caggatatgtggcggatgag

SEQ ID NO: 1703 - RNA, 20 nt, synthetic construct
  source 1..20: mol_type = other RNA; note = ABE8.17m
tgcgaatacgcccacgcgat

SEQ ID NO: 1704 - RNA, 22 nt, synthetic construct
  source 1..22: mol_type = other RNA; note = MGC1-4
cggcgtttcatctgtggtgcaa

SEQ ID NO: 1705 - RNA, 22 nt, synthetic construct
  source 1..22: mol_type = other RNA; note = MGC1-4
gccaggacagtcgtttgccgtc

SEQ ID NO: 1706 - RNA, 22 nt, synthetic construct
  source 1..22: mol_type = other RNA; note = MGC1-4
tcagccgcgctgtactggaggc

SEQ ID NO: 1707 - RNA, 22 nt, synthetic construct
  source 1..22: mol_type = other RNA; note = MGC1-6
cccttcccaacagttgcgcagc

SEQ ID NO: 1708 - RNA, 22 nt, synthetic construct
  source 1..22: mol_type = other RNA; note = MGC1-6
ctgtcgtcgtcccctcaaactg

SEQ ID NO: 1709 - RNA, 22 nt, synthetic construct
  source 1..22: mol_type = other RNA; note = MGC1-6
ctacgtctgaacgtcgaaaacc

SEQ ID NO: 1710 - RNA, 22 nt, synthetic construct
  source 1..22: mol_type = other RNA; note = MGC3-6
gtgacggcagttatctggaaga

SEQ ID NO: 1711 - RNA, 22 nt, synthetic construct
  source 1..22: mol_type = other RNA; note = MGC3-6
atgatttcagccgcgctgtact

SEQ ID NO: 1712 - RNA, 22 nt, synthetic construct
  source 1..22: mol_type = other RNA; note = MGC3-6
ttactgccgcctgttttgaccg

SEQ ID NO: 1713 - RNA, 22 nt, synthetic construct
  source 1..22: mol_type = other RNA; note = MGC3-7 PAL 159
cgaatggcgctttgcctggttt

SEQ ID NO: 1714 - RNA, 22 nt, synthetic construct
  source 1..22: mol_type = other RNA; note = MGC3-7
tcccctcaaactggcagatgca

SEQ ID NO: 1715 - RNA, 22 nt, synthetic construct
  source 1..22: mol_type = other RNA; note = MGC3-7
atctacaccaacgtgacctatc

SEQ ID NO: 1716 - RNA, 22 nt, synthetic construct
  source 1..22: mol_type = other RNA; note = MGC3-8
ttcatctgtggtgcaacgggcg

SEQ ID NO: 1717 - RNA, 22 nt, synthetic construct
  source 1..22: mol_type = other RNA; note = MGC3-8
acgagcatcatcctctgcatgg

SEQ ID NO: 1718 - RNA, 22 nt, synthetic construct
  source 1..22: mol_type = other RNA; note = MGC3-8
cgacccgcattgaccctaacgc

SEQ ID NO: 1719 - RNA, 22 nt, synthetic construct
  source 1..22: mol_type = other RNA; note = MGC4-5
caacgggcgctgggtcggttac

SEQ ID NO: 1720 - RNA, 22 nt, synthetic construct
  source 1..22: mol_type = other RNA; note = MGC4-5
cacaaatcagcgatttccatgt

SEQ ID NO: 1721 - RNA, 22 nt, synthetic construct
  source 1..22: mol_type = other RNA; note = MGC4-5
aaggcggcggagccgacaccac

SEQ ID NO: 1722 - RNA, 22 nt, synthetic construct
  source 1..22: mol_type = other RNA; note = MGC7-1
gccgatcgcgtcacactacgtc

SEQ ID NO: 1723 - RNA, 22 nt, synthetic construct
  source 1..22: mol_type = other RNA; note = MGC7-1
gatccgcgctggctaccggcga

SEQ ID NO: 1724 - RNA, 22 nt, synthetic construct
  source 1..22: mol_type = other RNA; note = MGC7-1
ccttcccgcccggtgcagtatg

SEQ ID NO: 1725 - RNA, 22 nt, synthetic construct
  source 1..22: mol_type = other RNA; note = MGC14-1 - PAL 174
cggtcaatccgccgtttgttcc

SEQ ID NO: 1726 - RNA, 22 nt, synthetic construct
  source 1..22: mol_type = other RNA; note = MGC14-1
tcctttgcgaatacgcccacgc

SEQ ID NO: 1727 - RNA, 22 nt, synthetic construct
  source 1..22: mol_type = other RNA; note = MGC14-1
ggtcggcttacggcggtgattt

SEQ ID NO: 1728 - RNA, 22 nt, synthetic construct
  source 1..22: mol_type = other RNA; note = MGC15-1
gccgatcgcgtcacactacgtc

SEQ ID NO: 1729 - RNA, 22 nt, synthetic construct
  source 1..22: mol_type = other RNA; note = MGC15-1
gatccgcgctggctaccggcga

SEQ ID NO: 1730 - RNA, 22 nt, synthetic construct
  source 1..22: mol_type = other RNA; note = MGC15-1
ccttcccgcccggtgcagtatg

SEQ ID NO: 1731 - RNA, 22 nt, synthetic construct
  source 1..22: mol_type = other RNA; note = MGC16-1
acgtgacctatcccattacggt

SEQ ID NO: 1732 - RNA, 22 nt, synthetic construct
  source 1..22: mol_type = other RNA; note = MGC16-1
atccgccgtttgttcccacgga

SEQ ID NO: 1733 - RNA, 22 nt, synthetic construct
  source 1..22: mol_type = other RNA; note = MGC16-1
cgacggcacgctgattgaagca

SEQ ID NO: 1734 - RNA, 22 nt, synthetic construct
  source 1..22: mol_type = other RNA; note = MGC18-1
tcagccgcgctgtactggaggc

SEQ ID NO: 1735 - RNA, 22 nt, synthetic construct
  source 1..22: mol_type = other RNA; note = MGC18-1
gaccagcccttcccggctgtgc

SEQ ID NO: 1736 - RNA, 22 nt, synthetic construct
  source 1..22: mol_type = other RNA; note = MGC18-1
tccgtttatccgggcaaaccat

SEQ ID NO: 1737 - RNA, 20 nt, synthetic construct
  source 1..20: mol_type = other RNA; note = BE3
cctctggatgtcgctccaca

SEQ ID NO: 1738 - RNA, 20 nt, synthetic construct
  source 1..20: mol_type = other RNA; note = BE3
gggacgcgcgaattgaatta

SEQ ID NO: 1739 - RNA, 20 nt, synthetic construct
  source 1..20: mol_type = other RNA; note = BE3
cgttttacaacgtcgtgact

SEQ ID NO: 1740 - DNA, 22 bp, synthetic construct
  source 1..22: mol_type = other DNA; note = MGA1-4 PAL113
acgggtgacagtttctttatgg

SEQ ID NO: 1741 - DNA, 22 bp, synthetic construct
  source 1..22: mol_type = other DNA; note = MGA1-4 PAL113
gcgggtgacagtttctttatgg

SEQ ID NO: 1742 - DNA, 22 bp, synthetic construct
  source 1..22: mol_type = other DNA; note = MGA3-7 PAL120
cacatttgatgttgatgaaagc

SEQ ID NO: 1743 - DNA, 22 bp, synthetic construct
  source 1..22: mol_type = other DNA; note = MGA3-7 PAL120
cacatttagtgttgatgaaagc

SEQ ID NO: 1744 - DNA, 22 bp, synthetic construct
  source 1..22: mol_type = other DNA; note = MGA3-7 P121
acacgagtcagcgatttccatg

SEQ ID NO: 1745 - DNA, 22 bp, synthetic construct
  source 1..22: mol_type = other DNA; note = MGA3-7 P121
acacaagtcagcgatttccatg

SEQ ID NO: 1746 - DNA, 22 bp, synthetic construct
  source 1..22: mol_type = other DNA; note = MGA3-7 PAL122
atgggtgggcagacgatggtgc

SEQ ID NO: 1747 - DNA, 22 bp, synthetic construct
  source 1..22: mol_type = other DNA; note = MGA3-7 PAL122
atggatgagcagacgatggtgc

SEQ ID NO: 1748 - DNA, 22 bp, synthetic construct
  source 1..22: mol_type = other DNA; note = MGA18-PAL144
aaaacccgaggctgtggagcgc

SEQ ID NO: 1749 - DNA, 22 bp, synthetic construct
  source 1..22: mol_type = other DNA; note = MGA18-PAL144
ggcggctctggctcacagtacg

SEQ ID NO: 1750 - DNA, 22 bp, synthetic construct
  source 1..22: mol_type = other DNA; note = MGC1-6 - PAL155
ctacgtttgaacgttgaaaacc

SEQ ID NO: 1751 - DNA, 22 bp, synthetic construct
  source 1..22: mol_type = other DNA; note = MGC3-7 - PAL 159
cgaatggcgctttgcttggttt

SEQ ID NO: 1752 - DNA, 22 bp, synthetic construct
  source 1..22: mol_type = other DNA; note = MGC3-7 - PAL 160
tttccttaaactggcagatgca

SEQ ID NO: 1753 - DNA, 22 bp, synthetic construct
  source 1..22: mol_type = other DNA; note = MGC3-7 - PAL 160
ttcccttaaactggcagatgca

SEQ ID NO: 1754 - DNA, 22 bp, synthetic construct
  source 1..22: mol_type = other DNA; note = MGC4-5 - PAL 169
cacaaattagcgatttccatgt

SEQ ID NO: 1755 - DNA, 22 bp, synthetic construct
  source 1..22: mol_type = other DNA; note = MGC4-5 - PAL 169
cacaaattagcgatttccatgt

SEQ ID NO: 1756 - DNA, 22 bp, synthetic construct
  source 1..22: mol_type = other DNA; note = MGC14-1 - PAL 174
cggttaatccgccgtttgttcc

SEQ ID NO: 1757 - DNA, 22 bp, synthetic construct
  source 1..22: mol_type = other DNA; note = MGC15-1 - PAL 172 - PAL 178
gatttgcgctggctaccggcga

SEQ ID NO: 1758 - DNA, 22 bp, synthetic construct
  source 1..22: mol_type = other DNA; note = MGC15-1 - PAL 172 - PAL 178
gattcgcgctggctaccggcga

SEQ ID NO: 1759 - DNA, 22 bp, synthetic construct
  source 1..22: mol_type = other DNA; note = MGC18-1 - PAL 183
ttagccgcgctgtactggaggc

SEQ ID NO: 1760 - DNA, 22 bp, synthetic construct
  source 1..22: mol_type = other DNA; note = MGC18-1 - PAL 183
ttagctgcgctgtactggaggc

SEQ ID NO: 1761 - DNA, 22 bp, synthetic construct
  source 1..22: mol_type = other DNA; note = MGC18-1 - PAL 183
ttagccgtgctgtactggaggc

SEQ ID NO: 1762 - DNA, 22 bp, synthetic construct
  source 1..22: mol_type = other DNA; note = MGC18-1 - PAL 184
gaccagcccttttcggctgtgc

SEQ ID NO: 1763 - DNA, 22 bp, synthetic construct
  source 1..22: mol_type = other DNA; note = MGC18-1 - PAL 184
gaccagccctttccggctgtgc

SEQ ID NO: 1764 - DNA, 22 bp, synthetic construct
  source 1..22: mol_type = other DNA; note = MGC18-1 - PAL 185
tttgtttatttgggcaaaccat

SEQ ID NO: 1765 - DNA, 22 bp, synthetic construct
  source 1..22: mol_type = other DNA; note = MGC18-1 - PAL 185
tttgtttattcgggcaaaccat

SEQ ID NO: 1766 - DNA, 22 bp, synthetic construct
  source 1..22: mol_type = other DNA; note = MGC15-1 and variants, which comprise an N-terminal APOBEC1
gatccgcgctggctaccggcga

SEQ ID NO: 1767 - DNA, 20 bp, synthetic construct
  source 1..20: mol_type = other DNA; note = MGC15-1 and variants, which comprise an N-terminal APOBEC1
ggcccagactgagcacgtga

SEQ ID NO: 1768 - DNA, 20 bp, synthetic construct
  source 1..20: mol_type = other DNA; note = NMG3-6 SITE 1
ggactctggccactccctgg

SEQ ID NO: 1769 - DNA, 20 bp, synthetic construct
  source 1..20: mol_type = other DNA; note = NMG1-4 SITE 1
cgtattgagaggtgggaatc

SEQ ID NO: 1770 - DNA, 20 bp, synthetic construct
  source 1..20: mol_type = other DNA; note = NMG18-1 SITE 1
gtgtcccccttccctatggg

SEQ ID NO: 1771 - DNA, 20 bp, synthetic construct
  source 1..20: mol_type = other DNA; note = NMG3-6 SITE 2
tccagctccagccccagagc

SEQ ID NO: 1772 - DNA, 20 bp, synthetic construct
  source 1..20: mol_type = other DNA; note = NMG1-4 SITE 2
ggagagcctgcctgcctggg

SEQ ID NO: 1773 - DNA, 20 bp, synthetic construct
  source 1..20: mol_type = other DNA; note = NMG18-1 SITE 2
cccttccctatgggaataat

SEQ ID NO: 1774 - DNA, 20 bp, synthetic construct
  source 1..20: mol_type = other DNA; note = NMG3-6 SITE 3; note = SGRNA708
ttccggctctgagggccagt

SEQ ID NO: 1775 - DNA, 20 bp, synthetic construct
  source 1..20: mol_type = other DNA; note = NMG1-4 SITE 3
ccccctctccctccatcagt

SEQ ID NO: 1776 - DNA, 20 bp, synthetic construct
  source 1..20: mol_type = other DNA; note = NMG18-1 SITE 3
gctccagccccagagcctgg

SEQ ID NO: 1777 - DNA, 20 bp, synthetic construct
  source 1..20: mol_type = other DNA; note = NMG3-6 SITE 4; note = SGRNA709
ccttctgtttgtcccacttg

SEQ ID NO: 1778 - DNA, 20 bp, synthetic construct
  source 1..20: mol_type = other DNA; note = NMG1-4 SITE 4
tacacagtttcccaagctac

SEQ ID NO: 1779 - DNA, 20 bp, synthetic construct
  source 1..20: mol_type = other DNA; note = NMG18-1 SITE 4
gcctctccctgcagacggta

SEQ ID NO: 1780 - DNA, 20 bp, synthetic construct
  source 1..20: mol_type = other DNA; note = NMG3-6 SITE 5
tctaggcctggcttggccaa

SEQ ID NO: 1781 - DNA, 20 bp, synthetic construct
  source 1..20: mol_type = other DNA; note = NMG3-6 SITE 6
cctgccgtgtaccagctgag

SEQ ID NO: 1782 - DNA, 20 bp, synthetic construct
  source 1..20: mol_type = other DNA; note = NMG3-6 SITE 7; note = SGRNA712
gcctatgggaactctggagg

SEQ ID NO: 1783 - DNA, 20 bp, synthetic construct
  source 1..20: mol_type = other DNA; note = SGRNA691; note = nSpCas9 Site 1
ttgccacgaagcaggccaat

SEQ ID NO: 1784 - DNA, 20 bp, synthetic construct
  source 1..20: mol_type = other DNA; note = BE3; note = SGRNA266
ggcccagactgagcacgtga

SEQ ID NO: 1785 - DNA, 20 bp, synthetic construct
  source 1..20: mol_type = other DNA; note = nSpCas9 Site 2 - base editing efficiencies of cytosine base editors; note = Cytosine Base Editors (CBEs) containing novel cytidine deaminases
cccggggccgccattgacag

SEQ ID NO: 1786 - DNA, 20 bp, synthetic construct
  source 1..20: mol_type = other DNA; note = nSpCas9 Site 3 - base editing efficiencies of cytosine base editors; note = SGRNA693
tccggctctgagggccagtg

SEQ ID NO: 1787 - DNA, 20 bp, synthetic construct
  source 1..20: mol_type = other DNA; note = nSpCas9 Site 4 - base editing efficiencies of cytosine base editors; note = SGRNA694
caaccagtccccagtgactc

SEQ ID NO: 1788 - DNA, 20 bp, synthetic construct
  source 1..20: mol_type = other DNA; note = nSpCas9 Site 5 - base editing efficiencies of cytosine base editors
gagtccgagcagaagaagaa

SEQ ID NO: 1789 - DNA, 21 bp, synthetic construct
  source 1..21: mol_type = other DNA; note = H193Y
ctggcgattcaggttcattat

SEQ ID NO: 1790 - DNA, 21 bp, synthetic construct
  source 1..21: mol_type = other DNA; note = WT
ctggcgattcaggttcatcat

SEQ ID NO: 1791 - RNA, 20 nt, synthetic construct
  source 1..20: mol_type = other RNA; note = SGRNA633; note = MG68-4V1-NMG34-1 SITE 1; note = TADA (8.8M) NMG34-1 SITE 1; note = MG68-4v1-nSpCas9 SITE 1
gaacacaaagcatagactgc

SEQ ID NO: 1792 - RNA, 20 nt, synthetic construct
  source 1..20: mol_type = other RNA; note = TADA (8.8M) NMG34-1 SITE 2; note = MG68-4V1-NMG34-1 SITE 2; note = SGRNA634; note = MG68-4v1-nSpCas9 SITE 2
gggaaagacccagcatccgt

SEQ ID NO: 1793 - RNA, 20 nt, synthetic construct
  source 1..20: mol_type = other RNA; note = TADA (8.8M) NMG34-1 SITE 3; note = MG68-4V1-NMG34-1 SITE 3; note = MG68-4v1-nSpCas9 SITE 3
gctcccatcacatcaaccgg

SEQ ID NO: 1794 - RNA, 20 nt, synthetic construct
  source 1..20: mol_type = other RNA; note = MG68-4V1-NMG34-1 SITE 4; note = TADA (8.8M) NMG34-1 SITE 4; note = MG68-4v1-nSpCas9 SITE 4
ggtgagtgagtgtgtgcgtg

SEQ ID NO: 1795 - RNA, 20 nt, synthetic construct
  source 1..20: mol_type = other RNA; note = TADA (8.8M) NMG34-1 SITE 5; note = MG68-4V1-NMG34-1 SITE 5; note = MG68-4v1-nSpCas9 SITE 5
ggcttcaggttctaaatgag

SEQ ID NO: 1796 - RNA, 20 nt, synthetic construct
  source 1..20: mol_type = other RNA; note = MG68-4V1-NMG34-1 SITE 6; note = TADA (8.8M) NMG34-1 SITE 6; note = MG68-4v1-nSpCas9 SITE 6
gcagagagtcgccgtctcca

SEQ ID NO: 1797 - RNA, 20 nt, synthetic construct
  source 1..20: mol_type = other RNA; note = SGRNA635; note = MG68-4V1-NMG34-1 SITE 7; note = TADA (8.8M) NMG34-1 SITE 7; note = MG68-4v1-nSpCas9 SITE 7
gatgagaaggagaagttctt

SEQ ID NO: 1798 - RNA, 20 nt, synthetic construct
  source 1..20: mol_type = other RNA; note = TADA (8.8M) NMG34-1 SITE 8; note = SGRNA636; note = MG68-4V1-NMG34-1 SITE 8; note = MG68-4v1-nSpCas9 SITE 8
agcaaacgcgttcagggcct

SEQ ID NO: 1799 - RNA, 20 nt, synthetic construct
  source 1..20: mol_type = other RNA; note = TADA (8.8M) NMG34-1 SITE 9; note = MG68-4V1-NMG34-1 SITE 9; note = MG68-4v1-nSpCas9 SITE 9
tgagtccgagcagaagaaga

SEQ ID NO: 1800 - RNA, 22 nt, synthetic construct
  source 1..22: mol_type = other RNA; note = ABE-MG34-1 SPCAS9
tctttatggcagggtgaaacgc

SEQ ID NO: 1801 - RNA, 22 nt, synthetic construct
  source 1..22: mol_type = other RNA; note = ABE-MG34-1 SPCAS9
gaaatcccgaatctctatcgtg

SEQ ID NO: 1802 - RNA, 22 nt, synthetic construct
  source 1..22: mol_type = other RNA; note = ABE-MG34-1 SPCAS9
atgagcgaacgcgtaacgcgaa

SEQ ID NO: 1803 - RNA, 22 nt, synthetic construct
  source 1..22: mol_type = other RNA; note = ABE-MG34-1 SPCAS9
gccggtcgctaccattaccagt

SEQ ID NO: 1804 - RNA, 22 nt, synthetic construct
  source 1..22: mol_type = other RNA; note = CBE-MG34-1 SPCAS9
cgcgccggagaaaaccgcctcg

SEQ ID NO: 1805 - RNA, 22 nt, synthetic construct
  source 1..22: mol_type = other RNA; note = CBE-MG34-1 SPCAS9
gagcatcatcctctgcatggtc

SEQ ID NO: 1806 - RNA, 22 nt, synthetic construct
  source 1..22: mol_type = other RNA; note = CBE-MG34-1 SPCAS9
gcattatccgaaccatccgctg

SEQ ID NO: 1807 - RNA, 22 nt, synthetic construct
  source 1..22: mol_type = other RNA; note = CBE-MG34-1 SPCAS9
gcccttcccggctgtgccgaaa

SEQ ID NO: 1808 - RNA, 20 nt, synthetic construct
  source 1..20: mol_type = other RNA; note = HEK293T cells with an ABE-MG34-1; note = MG68-4 variants in HEK293T cells
gatgagaaggagaagttctt

SEQ ID NO: 1809 - RNA, 20 nt, synthetic construct
  source 1..20: mol_type = other RNA; note = MG68-4 variants in HEK293T cells; note = HEK293T cells with an ABE-MG34-1
gggaaagacccagcatccgt

SEQ ID NO: 1810 - RNA, 20 nt, synthetic construct
  source 1..20: mol_type = other RNA; note = HEK293T cells with an ABE-MG34-1; note = MG68-4 variants in HEK293T cells
gaacacaaagcatagactgc

SEQ ID NO: 1811 - RNA, 24 nt, synthetic construct
  source 1..24: mol_type = other RNA; note = WT CAT H193Y; note = ABE-MG35-1 E. coli survival assay; note = ABE-MG35-1 E. coli survival assay
ccctggcgattcaggtgcactacg

SEQ ID NO: 1812 - protein, 8 aa, synthetic construct
  source 1..8: note = H193Y
PLAIQVHY

SEQ ID NO: 1813 - RNA, 24 nt, synthetic construct
  source 1..24: mol_type = other RNA; note = WT CAT H193Y
cgtagtgcacctgaatcgccaggg

SEQ ID NO: 1814 - RNA, 22 nt, synthetic construct
  source 1..22: mol_type = other RNA; note = SGRNA710
ttggccaagccaggcctagaat

SEQ ID NO: 1815 - RNA, 22 nt, synthetic construct
  source 1..22: mol_type = other RNA; note = SGRNA711
ctcagctggtacacggcagggt

SEQ ID NO: 1816 - RNA, 21 nt, synthetic construct
  source 1..21: mol_type = other RNA; note = SGRNA641
ggtcgtagccagtccgaaccc

SEQ ID NO: 1817 - DNA, 62 bp, synthetic construct
  source 1..62: mol_type = other DNA; note = MG139-52 activity highlighting the G-A
tcaccgacctctctccccagggggatccaccggagcttaagacgggactaggtcaggccggg

SEQ ID NO: 1818 - RNA, 70 nt, synthetic construct
  source 1..70: mol_type = other RNA; note = MG68-4 variants in HEK293T cells
ggtcgtaaaaaaagccaaaaaaaaaaagtccgaaaaaaaaaaaaaaaaaaaaaaaaaaaaaaaaaaaccc

SEQ ID NO: 1819 - DNA, 33 bp, synthetic construct
  source 1..33: mol_type = other DNA; note = ABE-MG35-1 E. coli survival assay
gacggcgtagtgcacctgaatcgccaggggcat

SEQ ID NO: 1820 - DNA, 33 bp, synthetic construct
  source 1..33: mol_type = other DNA; note = ABE-MG35-1 E. coli survival assay
atgcccctggcgattcaggcgcaccacgccgtc

SEQ ID NO: 1821 - DNA, 33 bp, synthetic construct
  source 1..33: mol_type = other DNA; note = ABE-MG35-1 E. coli survival assay
atgcccctggcgattcaggtgcactacgccgtc

SEQ ID NO: 1822 - protein, 11 aa, synthetic construct
  source 1..11: note = ABE-MG35-1 E. coli survival assay
MPLAIQVHYAV

SEQ ID NO: 1823 - RNA, 22 nt, synthetic construct
  source 1..22: mol_type = other RNA; note = ADENINES TARGETED BY GUIDE H
acagacaaaactgtgctagaca

SEQ ID NO: 1824 - RNA, 40 nt, synthetic construct
  source 1..40: mol_type = other RNA; note = heteroduplex in the R-loop; note = MG139-52 wt and mutated at N27 to A
ccccagggggatccaccggagcttaagacgggactaggtc

SEQ ID NO: 1825 - RNA, 40 nt, synthetic construct
  source 1..40: mol_type = other RNA; note = heteroduplex in the R-loop; note = MG139-52 wt and mutated at N27 to A
ccccagggggatctactggagcttaagacgggactaggtc

SEQ ID NO: 1826 - RNA, 40 nt, synthetic construct
  source 1..40: mol_type = other RNA; note = heteroduplex in the R-loop; note = MG139-52 wt and mutated at N27 to A
ccccagggggatctaccggagcttaagacgggactaggtc

SEQ ID NO: 1827 - RNA, 40 nt, synthetic construct
  source 1..40: mol_type = other RNA; note = MG139-52 wt and mutated at N27 to A; note = heteroduplex in the R-loop
ccccagggggatccactggagcttaagacgggactaggtc

SEQ ID NO: 1828 - RNA, 40 nt, synthetic construct
  source 1..40: mol_type = other RNA; note = heteroduplex in the R-loop; note = MG139-52 wt and mutated at N27 to A
ctccagggggatctactggagcttaagacgggactaggtc

SEQ ID NO: 1829 - RNA, 40 nt, synthetic construct
  source 1..40: mol_type = other RNA; note = heteroduplex in the R-loop; note = MG139-52 wt and mutated at N27 to A
ctctagggggatctactggagcttaagacgggactaggtc

SEQ ID NO: 1830 - RNA, 40 nt, synthetic construct
  source 1..40: mol_type = other RNA; note = heteroduplex in the R-loop
ccccagggggatccaccagagcttaagacgggactaggtc

SEQ ID NO: 1831 - RNA, 40 nt, synthetic construct
  source 1..40: mol_type = other RNA; note = heteroduplex in the R-loop
ccccagggggatctactagagcttaagacgggactaggtc

SEQ ID NO: 1832 - RNA, 40 nt, synthetic construct
  source 1..40: mol_type = other RNA; note = heteroduplex in the R-loop
ctctagggggatctactagagcttaagacgggactaggtc

SEQ ID NO: 1833 - RNA, 40 nt, synthetic construct
  source 1..40: mol_type = other RNA; note = heteroduplex in the R-loop; note = MG139-52 wt and mutated at N27 to A
ctccagggggatctaccggagcttaagacgggactaggtc

SEQ ID NO: 1834 - RNA, 40 nt, synthetic construct
  source 1..40: mol_type = other RNA; note = heteroduplex in the R-loop; note = MG139-52 wt and mutated at N27 to A
ctccagggggatccaccggagcttaagacgggactaggtc

SEQ ID NO: 1835 - RNA, 40 nt, synthetic construct
  source 1..40: mol_type = other RNA; note = heteroduplex in the R-loop; note = MG139-52 wt and mutated at N27 to A
cttcagggggatctactggagcttaagacgggactaggtc

SEQ ID NO: 1836 - RNA, 40 nt, synthetic construct
  source 1..40: mol_type = other RNA; note = heteroduplex in the R-loop
ctccagggggatccactggagcttaagacgggactaggtc

SEQ ID NO: 1837 - RNA, 40 nt, synthetic construct
  source 1..40: mol_type = other RNA; note = heteroduplex in the R-loop
ctccagggggatctactagagcttaagacgggactaggtc

SEQ ID NO: 1838 - RNA, 40 nt, synthetic construct
  source 1..40: mol_type = other RNA; note = MG139-52 wt and mutated at N27 to A
ctttagggggatctactggagcttaagacgggactaggtc

SEQ ID NO: 1839 - RNA, 40 nt, synthetic construct
  source 1..40: mol_type = other RNA; note = MG139-52 wt and mutated at N27 to A
ctttagggggatctaccggagcttaagacgggactaggtc

SEQ ID NO: 1840 - RNA, 40 nt, synthetic construct
  source 1..40: mol_type = other RNA; note = MG139-52 wt and mutated at N27 to A
cttcagggggatctaccggagcttaagacgggactaggtc

SEQ ID NO: 1841 - RNA, 40 nt, synthetic construct
  source 1..40: mol_type = other RNA; note = MG139-52 wt and mutated at N27 to A
ctctagggggatctaccggagcttaagacgggactaggtc

SEQ ID NO: 1842 - RNA, 40 nt, synthetic construct
  source 1..40: mol_type = other RNA; note = MG139-52 wt and mutated at N27 to A
ctctagggggatttactggagcttaagacgggactaggtc

SEQ ID NO: 1843 - RNA, 40 nt, synthetic construct
  source 1..40: mol_type = other RNA; note = MG139-52 wt and mutated at N27 to A
ctttagggggatttactggagcttaagacgggactaggtc

SEQ ID NO: 1844 - RNA, 40 nt, synthetic construct
  source 1..40: mol_type = other RNA; note = MG139-52 wt and mutated at N27 to A
ctttagggagatctactggagcttaagacgggactaggtc

SEQ ID NO: 1845 - RNA, 40 nt, synthetic construct; identical to SEQ ID NO: 1824
  source 1..40: mol_type = other RNA; note = MG139-52 wt and mutated at N27 to A

SEQ ID NO: 1846 - RNA, 40 nt, synthetic construct; identical to SEQ ID NO: 1835
  source 1..40: mol_type = other RNA; note = MG139-52 wt and mutated at N27 to A

SEQ ID NO: 1847 - RNA, 40 nt, synthetic construct; identical to SEQ ID NO: 1829
  source 1..40: mol_type = other RNA; note = MG139-52 wt and mutated at N27 to A

SEQ ID NO: 1848 - RNA, 40 nt, synthetic construct; identical to SEQ ID NO: 1825
  source 1..40: mol_type = other RNA; note = MG139-52 wt and mutated at N27 to A

SEQ ID NO: 1849 - RNA, 40 nt, synthetic construct; identical to SEQ ID NO: 1826
  source 1..40: mol_type = other RNA; note = MG139-52 wt and mutated at N27 to A

SEQ ID NO: 1850 - RNA, 40 nt, synthetic construct; identical to SEQ ID NO: 1834
  source 1..40: mol_type = other RNA; note = MG139-52 wt and mutated at N27 to A

SEQ ID NO: 1851 - RNA, 40 nt, synthetic construct; identical to SEQ ID NO: 1833
  source 1..40: mol_type = other RNA; note = MG139-52 wt and mutated at N27 to A

SEQ ID NO: 1852 - RNA, 40 nt, synthetic construct; identical to SEQ ID NO: 1828
  source 1..40: mol_type = other RNA; note = MG139-52 wt and mutated at N27 to A

SEQ ID NO: 1853 - RNA, 20 nt, synthetic construct
  source 1..20: mol_type = other RNA; note = MG68-4 LINKER
gggaaagacccagcatccgt

SEQ ID NO: 1854 - RNA, 25 nt, synthetic construct
  source 1..25: mol_type = other RNA; note = MG68-4 LINKER
gaacaccccccaaagcatagactgc

SEQ ID NO: 1855 - RNA, 22 nt, synthetic construct
  source 1..22: mol_type = other RNA; note = SGRNA68
acagacaaaactgtgctagaca

SEQ ID NO: 1856 - RNA, 22 nt, synthetic construct
  source 1..22: mol_type = other RNA; note = SGRNA68
acagacaaaactgtgctagaca

SEQ ID NO: 1857 - DNA, 42 bp, synthetic construct
  source 1..42: mol_type = other DNA; note = CAT STOP 98 FRAME 1 COMPLEMENT
tgttacaccgtcttccacgagtaaaccgaaacgttttcatcg

SEQ ID NO: 1858 - protein, 7 aa, synthetic construct
  source 1..7: note = CAT STOP 98 FRAME 1 COMPLEMENT
CYTVFHE

SEQ ID NO: 1859 - DNA, 42 bp, synthetic construct
  source 1..42: mol_type = other DNA; note = CAT STOP 98 FRAME 1 COMPLEMENT
cgatgaaaacgtttcggtttactcgtggaagacggtgtaaca

SEQ ID NO: 1860 - DNA, 36 bp, synthetic construct
  source 1..36: mol_type = other DNA; note = CAT STOP 122 FRAME 1 COMPLEMENT
tttctccatatatacagctaagacgtggcgtgttac

SEQ ID NO: 1861 - protein, 6 aa, synthetic construct
  source 1..6: note = CAT STOP 122 FRAME 1 COMPLEMENT
FLHIYS

SEQ ID NO: 1862 - DNA, 36 bp, synthetic construct
  source 1..36: mol_type = other DNA; note = CAT STOP 122 FRAME 1 COMPLEMENT
gtaacacgccacgtcttagctgtatatatggagaaa

SEQ ID NO: 1863 - DNA, 101 bp, synthetic construct
  source 1..101: mol_type = other DNA; note = nMG35-1 ABE base editing in an E. coli
caccgtcttccacgagtaaaccgaaacgttttcatcgctctggagtgaataccacgacgatttccggcagtttctccatatatacagctaagacgtggcgt

SEQ ID NO: 1864 - protein, 5 aa, synthetic construct
  source 1..5: note = nMG35-1 ABE base editing in an E. coli
TVFHE

SEQ ID NO: 1865 - DNA, 101 bp, synthetic construct
  source 1..101: mol_type = other DNA; note = nMG35-1 ABE base editing in an E. coli
acgccacgtcttagctgtatatatggagaaactgccggaaatcgtcgtggtattcactccagagcgatgaaaacgtttcggtttactcgtggaagacggtg

SEQ ID NO: 1866 - DNA, 101 bp, synthetic construct
  source 1..101: mol_type = other DNA; note = nMG35-1 ABE base editing in an E. coli
caccgtcttccacgagcaaaccgaaacgttttcatcgctctggagtgaataccacgacgatttccggcagtttctccatatatacagccaagacgtggcgt

SEQ ID NO: 1867 - DNA, 101 bp, synthetic construct
  source 1..101: mol_type = other DNA; note = nMG35-1 ABE base editing in an E. coli
acgccacgtcttggctgtatatatggagaaactgccggaaatcgtcgtggtattcactccagagcgatgaaaacgtttcggtttgctcgtggaagacggtg

SEQ ID NO: 1868 - DNA, 101 bp, synthetic construct; identical to SEQ ID NO: 1866
  source 1..101: mol_type = other DNA; note = nMG35-1 ABE base editing in an E. coli

SEQ ID NO: 1869 - DNA, 101 bp, synthetic construct; identical to SEQ ID NO: 1867
  source 1..101: mol_type = other DNA; note = nMG35-1 ABE base editing in an E. coli

SEQ ID NO: 1870 - protein, 5 aa, synthetic construct
  source 1..5: note = peptide sequences of linkers suitable for the engineered nucleic acid
GSGGS

SEQ ID NO: 1871 - protein, 5 aa, synthetic construct
  source 1..5: note = peptide sequences of linkers suitable for the engineered nucleic acid
SGGSS

SEQ ID NO: 1872 - protein, 4 aa, synthetic construct
  source 1..4: note = peptide sequences of linkers suitable for the engineered nucleic acid
GAAA

SEQ ID NO: 1873 - DNA, 68 bp, synthetic construct
  source 1..68: mol_type = other DNA; note = Ribosomal binding site and an N-terminal hexahistidine tag
gaaataattttgtttaactttaagaaggagatatacatatgggcagcagtcatcatcatcaccatcac

SEQ ID NO: 1874 - protein, 6 aa, synthetic construct
  source 1..6: note = 6xHis tag
HHHHHH

SEQ ID NO: 1875 - DNA, 17 bp, synthetic construct
  source 1..17: mol_type = other DNA; note = BmtI restriction site and Kozak sequence
accggtgctagcccacc

SEQ ID NO: 1876 - DNA, 22 bp, synthetic construct
  source 1..22: mol_type = other DNA; note = MGA3-7 PAL122
atggatgagcggacgatggtgc

SEQ ID NO: 1877 - DNA, 22 bp, synthetic construct
  source 1..22: mol_type = other DNA; note = MGC4-5 - PAL 169
cacaaattagcgattttcatgt

SEQ ID NO: 1878 - protein, 13 aa, synthetic construct
  source 1..13: note = MG139-52 activity highlighting the G-A
PDVPASTGLGQAG

SEQ ID NO: 1879 - DNA, 62 bp, synthetic construct
  source 1..62: mol_type = other DNA; note = MG139-52 activity highlighting the G-A
tcactgacctctctctctagggggatctactagagcttaagacgggactaggtcaggccggg

SEQ ID NO: 1880 - DNA, 33 bp, synthetic construct
  source 1..33: mol_type = other DNA; note = ABE-MG35-1 E. coli survival assay
atgcccctggcgattcaggtgcaccacgccgtc

SEQ ID NO: 1881 - DNA, 40 bp, synthetic construct
  source 1..40: mol_type = other DNA; note = MG139-52 wt and mutated at N27 to A
cttcagggggatccaccggagcttaagacgggactaggtc

SEQ ID NO: 1882 - DNA, 40 bp, synthetic construct
  source 1..40: mol_type = other DNA; note = MG139-52 wt and mutated at N27 to A
cttcagggagatctactggagcttaagacgggactaggtc

SEQ ID NO: 1883 - DNA, 40 bp, synthetic construct
  source 1..40: mol_type = other DNA; note = MG139-52 wt and mutated at N27 to A
ctctagggagatctactggagcttaagacgggactaggtc

SEQ ID NO: 1884 - DNA, 40 bp, synthetic construct
  source 1..40: mol_type = other DNA; note = MG139-52 wt and mutated at N27 to A
ctctagggggatccaccggagcttaagacgggactaggtc

SEQ ID NO: 1885 - DNA, 40 bp, synthetic construct
  source 1..40: mol_type = other DNA; note = MG139-52 wt and mutated at N27 to A
cctcagggggatctaccggagcttaagacgggactaggtc

SEQ ID NO: 1886 - DNA, 40 bp, synthetic construct
  source 1..40: mol_type = other DNA; note = MG139-52 wt and mutated at N27 to A
cttcagggggatttactggagcttaagacgggactaggtc

SEQ ID NO: 1887 - DNA, 40 bp, synthetic construct
  source 1..40: mol_type = other DNA; note = MG139-52 wt and mutated at N27 to A
cttcagggggatccactggagcttaagacgggactaggtc

SEQ ID NO: 1888 - DNA, 40 bp, synthetic construct
  source 1..40: mol_type = other DNA; note = MG139-52 wt and mutated at N27 to A
ctttagggggatccaccggagcttaagacgggactaggtc

SEQ ID NO: 1889 - protein, 6 aa, synthetic construct
  source 1..6: note = CAT STOP 98 FRAME 1 COMPLEMENT
TETFSS

SEQ ID NO: 1890 - protein, 5 aa, synthetic construct
  source 1..5: note = CAT STOP 122 FRAME 1 COMPLEMENT
DVACY

SEQ ID NO: 1891 - protein, 23 aa, synthetic construct
  source 1..23: note = nMG35-1 ABE base editing in an E. coli
TETFSSLWSEYHDDFRQFLHIYS

SEQ ID NO: 1892 - DNA, 101 bp, synthetic construct
  source 1..101: mol_type = other DNA; note = nMG35-1 ABE base editing in an E. coli
caccgtcttccncgagtaaaccgaaacgttttcatcgctctggagtgaataccacgacgatttccggcagtttctccatatatacagctaagacgtggcgt

SEQ ID NO: 1893 - DNA, 101 bp, synthetic construct
  source 1..101: mol_type = other DNA; note = nMG35-1 ABE base editing in an E. coli
acgccacgtcttagctgtatatatggagaaactgccggaaatcgtcgtggtattcactccagagcgatgaaaacgtttcggtttactcgnggaagacggtg

SEQ ID NO: 1894 - DNA, 50 bp, unidentified
  source 1..50: mol_type = unassigned DNA; note = ssDNA substrate for testing ADA in vitro
ttattattattagacattattattattatattattattattatattatta

What is claimed is:

1. An engineered nucleic acid editing system comprising:

(a) a cytidine deaminase or a nucleic acid encoding said cytidine deaminase, wherein said cytidine deaminase comprises a sequence having at least 80% sequence identity to any one of SEQ ID NOs: 774 or 835; and (b) an endonuclease domain or a nucleic acid encoding said endonuclease domain, wherein said cytidine deaminase is fused or linked to said endonuclease domain.

2. The engineered nucleic acid editing system of claim 1, wherein said cytidine deaminase comprises a sequence having at least 90% sequence identity to any one of SEQ ID NOs: 774 or 835.

3. The engineered nucleic acid editing system of claim 2, wherein said cytidine deaminase comprises the sequence of SEQ ID NO: 774.

4. The engineered nucleic acid editing system of claim 2, wherein said cytidine deaminase comprises the sequence of SEQ ID NO: 835.

5. The engineered nucleic acid editing system of claim 1, wherein said endonuclease domain comprises a nickase.

6. The engineered nucleic acid editing system of claim 1, wherein said engineered nucleic acid editing system further comprises one or more of: a uracil DNA glycosylase inhibitor or a nucleic acid encoding said uracil DNA glycosylase inhibitor, wherein said uracil DNA glycosylase inhibitor comprises a sequence having 80% sequence identity to any one of SEQ ID NOs: 52-56 or 67, or a FAM72A protein or a nucleic acid encoding said FAM72A protein.

7. The engineered nucleic acid editing system of claim 1, further comprising an engineered guide polynucleotide or a nucleic acid encoding said engineered guide polynucleotide, wherein said engineered guide polynucleotide comprises:
(i) a guide ribonucleic acid sequence configured to hybridize to a target deoxyribonucleic acid sequence; and
(ii) a tracr ribonucleic acid sequence configured to bind to said endonuclease domain.

8. The engineered nucleic acid editing system of claim 7, wherein said guide ribonucleic acid sequence comprises a sequence having at least 80% sequence identity to at least 18 consecutive nucleotides of any one of SEQ ID NOs: 1491-1492.

9. The engineered nucleic acid editing system of claim 1, wherein said cytidine deaminase is fused to said endonuclease domain.

10. The engineered nucleic acid editing system of claim 9, wherein said cytidine deaminase comprises the sequence of SEQ ID NO: 774.

11. The engineered nucleic acid editing system of claim 9, wherein said cytidine deaminase comprises the sequence of SEQ ID NO: 835.

12. The engineered nucleic acid editing system of claim 1, wherein said cytidine deaminase is linked to said endonuclease domain.

13. A method of deaminating a cytosine residue in a nucleic acid sequence in a eukaryotic cell, said method comprising contacting to said nucleic acid sequence a polypeptide comprising a cytidine deaminase, wherein said cytidine deaminase comprises a sequence having at least 80% sequence identity to any one of SEQ ID NOs: 774 or 835.

14. The method of claim 13, wherein said cytidine deaminase comprises a sequence having at least 90% sequence identity to any one of SEQ ID NOs: 774 or 835.

15. The method of claim 14, wherein said cytidine deaminase comprises the sequence of SEQ ID NO: 774.

16. The method of claim 14, wherein said cytidine deaminase comprises the sequence of SEQ ID NO: 835.

17. The method of claim 13, wherein said polypeptide is fused to an endonuclease.

18. The method of claim 17, wherein said endonuclease comprises a nickase.

19. The method of claim 13, wherein said eukaryotic cell is a mammalian, primate, or human cell.

20. The method of claim 13, wherein said nucleic acid sequence is a TRAC locus.

21. The method of claim 20, wherein said nucleic acid sequence comprises a sequence having at least 80% sequence identity to at least 18 consecutive nucleotides of any one of SEQ ID NOs: 1491-1492.

22. The method of claim 13, wherein said polypeptide is linked to an endonuclease.

23. A method of editing a TRAC locus in a eukaryotic cell, said method comprising contacting said TRAC locus with a polypeptide comprising a cytidine deaminase, wherein said cytidine deaminase comprises a sequence having at least 80% sequence identity to any one any one of SEQ ID NOs: 774 or 835, thereby editing said TRAC locus in said eukaryotic cell.

24. The method of claim 23, wherein said cytidine deaminase comprises a sequence having at least 90% sequence identity to any one of SEQ ID NOs: 774 or 835.

25. The method of claim 24, wherein said cytidine deaminase comprises the sequence of SEQ ID NO: 774.

26. The method of claim 24, wherein said cytidine deaminase comprises the sequence of SEQ ID NO: 835.

27. The method of claim 23, wherein said polypeptide is fused to an endonuclease.

28. The method of claim 27, further comprising contacting said TRAC locus with an engineered guide polynucleotide, wherein said engineered guide polynucleotide is configured to form a complex with said endonuclease and said engineered guide polynucleotide comprises a spacer sequence configured to hybridize to a region of said TRAC locus.

29. The method of claim 28, wherein said spacer sequence comprises a sequence having at least 80% sequence identity to at least 18 consecutive nucleotides of any one of SEQ ID NOs: 1491-1492.

30. The method of claim 27, wherein said endonuclease is a nickase.

* * * * *